US012297285B2

(12) United States Patent
Barnes et al.

(10) Patent No.: US 12,297,285 B2
(45) Date of Patent: May 13, 2025

(54) CIRCULAR RNA ENCODING CHIMERIC ANTIGEN RECEPTORS TARGETING BCMA

(71) Applicant: Orna Therapeutics, Inc., Cambridge, MA (US)

(72) Inventors: Thomas Barnes, Watertown, MA (US); Amy M. Becker, Watertown, MA (US); Brian Goodman, Watertown, MA (US); Jui Dutta-Simmons, Watertown, MA (US)

(73) Assignee: Orna Therapeutics, Inc., Watertown, MA (US)

( * ) Notice: Subject to any disclaimer, the term of this patent is extended or adjusted under 35 U.S.C. 154(b) by 0 days.

(21) Appl. No.: 17/853,576

(22) Filed: Jun. 29, 2022

(65) Prior Publication Data
US 2024/0052049 A1    Feb. 15, 2024

Related U.S. Application Data

(60) Provisional application No. 63/355,527, filed on Jun. 24, 2022.

(51) Int. Cl.
| | | |
|---|---|---|
| *C07K 16/28* | (2006.01) | |
| *A61K 38/00* | (2006.01) | |
| *A61K 39/00* | (2006.01) | |
| *A61K 47/28* | (2006.01) | |
| *A61K 47/69* | (2017.01) | |
| *A61K 48/00* | (2006.01) | |
| *A61P 35/00* | (2006.01) | |
| *C07K 14/725* | (2006.01) | |

(52) U.S. Cl.
CPC .......... *C07K 16/2878* (2013.01); *A61K 47/28* (2013.01); *A61K 47/6929* (2017.08); *A61K 48/0033* (2013.01); *A61P 35/00* (2018.01); *C07K 14/7051* (2013.01); *C07K 16/2803* (2013.01); *A61K 38/00* (2013.01); *A61K 39/00* (2013.01); *C07K 2319/00* (2013.01)

(58) Field of Classification Search
None
See application file for complete search history.

(56) References Cited

U.S. PATENT DOCUMENTS

| | | |
|---|---|---|
| 3,832,253 A | 8/1974 | Di et al. |
| 3,854,480 A | 12/1974 | Zaffaroni |
| 4,235,871 A | 11/1980 | Papahadjopoulos et al. |
| 4,323,689 A | 4/1982 | Vogel et al. |
| 4,450,150 A | 5/1984 | Sidman |
| 4,452,775 A | 6/1984 | Kent |
| 4,501,728 A | 2/1985 | Geho et al. |
| 4,661,450 A | 4/1987 | Kempe et al. |
| 4,667,014 A | 5/1987 | Nestor, Jr. et al. |
| 4,737,323 A | 4/1988 | Martin et al. |
| 4,748,034 A | 5/1988 | de Rham |
| 4,837,028 A | 6/1989 | Allen |
| 4,897,355 A | 1/1990 | Eppstein et al. |
| 5,019,369 A | 5/1991 | Presant et al. |
| 5,075,109 A | 12/1991 | Tice et al. |
| 5,087,616 A | 2/1992 | Myers et al. |
| 5,171,678 A | 12/1992 | Behr et al. |
| 5,239,660 A | 8/1993 | Ooi |
| 5,334,761 A | 8/1994 | Gebeyehu et al. |
| 5,434,261 A | 7/1995 | Schoen et al. |
| 5,580,859 A | 12/1996 | Felgner et al. |
| 5,591,737 A | 1/1997 | Doherty et al. |
| 5,625,047 A | 4/1997 | Been et al. |
| 5,629,304 A | 5/1997 | Murakata et al. |
| 5,656,606 A | 8/1997 | Nargund et al. |
| 5,672,596 A | 9/1997 | Wyvratt et al. |
| 5,712,128 A | 1/1998 | Been et al. |
| 5,744,335 A | 4/1998 | Wolff et al. |
| 5,747,485 A | 5/1998 | Doherty et al. |
| 5,755,903 A | 5/1998 | Garant et al. |
| 5,766,903 A | 6/1998 | Sarnow |
| 5,773,244 A | 6/1998 | Ares, Jr. et al. |
| 5,885,613 A | 3/1999 | Holland et al. |
| 5,948,902 A | 9/1999 | Honkanen et al. |

(Continued)

FOREIGN PATENT DOCUMENTS

| | | |
|---|---|---|
| CN | 101016264 A | 8/2007 |
| CN | 105176981 A | 12/2015 |

(Continued)

OTHER PUBLICATIONS

Al-Lazikani et al. "Standard conformations for the canonical structures of immunoglobulins," J Mol Biol, 1997, 273(4):927-48.

Badelt et al. "Computational Design of a Circular RNA with Prionlike Behavior," Artif Life., 2016, 22(2):172-84.

Bail et al. "Tri- to be mono- for bacterial mRNA decay," Structure, 2009, 17(3):317-9.

Barretina et al. "The Cancer Cell Line Encyclopedia enables predictive modelling of anticancer drug sensitivity," Nature, 2012, 483(7391):603-7.

(Continued)

*Primary Examiner* — Peter J Reddig
(74) *Attorney, Agent, or Firm* — Goodwin Procter LLP

(57) ABSTRACT

Circular RNA, along with related compositions and methods are described herein. In some embodiments, the inventive circular RNA comprises group I intron fragments, spacers, an IRES, duplex forming regions, and an expression sequence. In some embodiments, the expression sequence encodes an antigen. In some embodiments, circular RNA of the invention has improved expression, functional stability, immunogenicity, ease of manufacturing, and/or half-life when compared to linear RNA. In some embodiments, inventive methods and constructs result in improved circularization efficiency, splicing efficiency, and/or purity when compared to existing RNA circularization approaches.

32 Claims, 157 Drawing Sheets

Specification includes a Sequence Listing.

(56) References Cited

U.S. PATENT DOCUMENTS

| | | | |
|---|---|---|---|
| 5,972,964 A | 10/1999 | Perregaard | |
| 6,043,026 A | 3/2000 | Patchett et al. | |
| 6,210,931 B1 | 4/2001 | Feldstein et al. | |
| 6,211,174 B1 | 4/2001 | Devita et al. | |
| 6,319,494 B1 | 11/2001 | Capon et al. | |
| 6,368,802 B1 | 4/2002 | Kool | |
| 6,417,326 B1 | 7/2002 | Cullis et al. | |
| 6,576,628 B1 | 6/2003 | Grams et al. | |
| 6,620,597 B1 | 9/2003 | Chen et al. | |
| 7,709,226 B2 | 5/2010 | Foote | |
| 7,741,465 B1 | 6/2010 | Eshhar et al. | |
| 8,158,601 B2 | 4/2012 | Chen et al. | |
| 8,829,170 B2 | 9/2014 | Dale et al. | |
| 9,708,628 B2 | 7/2017 | Tange et al. | |
| 9,765,022 B2 | 9/2017 | Xu et al. | |
| 10,799,463 B2 | 10/2020 | Benenato et al. | |
| 11,203,767 B2 | 12/2021 | Anderson et al. | |
| 11,352,640 B2 | 6/2022 | Anderson et al. | |
| 11,352,641 B2 | 6/2022 | Anderson et al. | |
| 11,447,796 B2 | 9/2022 | Anderson et al. | |
| 11,603,396 B2 * | 3/2023 | Wesselhoeft | C07K 14/7051 |
| 11,679,120 B2 | 6/2023 | Horhota et al. | |
| 2004/0014194 A1 | 1/2004 | Beyer et al. | |
| 2006/0199851 A1 | 9/2006 | Kempf et al. | |
| 2010/0137407 A1 | 6/2010 | Abe et al. | |
| 2010/0305197 A1 | 12/2010 | Che | |
| 2011/0019782 A1 | 1/2011 | Kobayashi et al. | |
| 2015/0079630 A1 | 3/2015 | Abe et al. | |
| 2016/0083747 A1 | 3/2016 | Kruse | |
| 2016/0194368 A1 | 7/2016 | Hoge et al. | |
| 2016/0331828 A1 | 11/2016 | Ciaramella et al. | |
| 2017/0204422 A1 | 7/2017 | Nelson et al. | |
| 2018/0010175 A1 | 1/2018 | Cheng | |
| 2018/0153822 A1 | 6/2018 | Karve et al. | |
| 2018/0230225 A1 * | 8/2018 | Fan | C12N 5/0636 |
| 2018/0311343 A1 | 11/2018 | Huang et al. | |
| 2018/0326045 A1 | 11/2018 | Ciaramella et al. | |
| 2019/0091164 A1 | 3/2019 | Horhota et al. | |
| 2019/0290694 A1 | 9/2019 | Gautron et al. | |
| 2019/0314284 A1 | 10/2019 | Guild et al. | |
| 2019/0314291 A1 | 10/2019 | Besin et al. | |
| 2019/0314524 A1 | 10/2019 | Ansell et al. | |
| 2019/0321489 A1 | 10/2019 | Guild et al. | |
| 2019/0328769 A1 | 10/2019 | Uchida et al. | |
| 2019/0345503 A1 | 11/2019 | Chang et al. | |
| 2020/0040370 A1 | 2/2020 | Eber et al. | |
| 2020/0080106 A1 | 3/2020 | Anderson et al. | |
| 2021/0085719 A1 | 3/2021 | Jensen | |
| 2021/0371494 A1 * | 12/2021 | Wesselhoeft | A61K 48/005 |
| 2022/0106259 A1 | 4/2022 | Benenato et al. | |
| 2022/0323480 A1 | 10/2022 | Goodman et al. | |
| 2023/0050306 A1 | 2/2023 | Anderson et al. | |
| 2023/0058784 A1 | 2/2023 | Goodman et al. | |
| 2023/0062665 A1 | 3/2023 | Goodman et al. | |
| 2023/0226096 A1 | 7/2023 | Goodman et al. | |

FOREIGN PATENT DOCUMENTS

| | | | |
|---|---|---|---|
| CN | 106801050 A | 6/2017 | |
| EP | 2819377 A1 | 12/2014 | |
| EP | 3630966 A1 | 4/2020 | |
| EP | 3819377 A1 | 5/2021 | |
| GB | 2308064 A | 6/1997 | |
| JP | 2016/521133 A | 7/2016 | |
| JP | 2017043556 A | 3/2017 | |
| JP | 6284181 B2 | 2/2018 | |
| KR | 2011/0095439 A | 8/2011 | |
| WO | WO-1995/011029 A1 | 4/1995 | |
| WO | WO-1995/024207 A1 | 9/1995 | |
| WO | WO-1999/055743 A1 | 11/1999 | |
| WO | WO-2005/044201 A2 | 5/2005 | |
| WO | WO-2005/079803 A1 | 9/2005 | |
| WO | WO-2005/121348 A1 | 12/2005 | |
| WO | WO-2006/138380 A2 | 12/2006 | |
| WO | WO-2007/044627 A2 | 4/2007 | |
| WO | WO-2008/103276 A2 | 8/2008 | |
| WO | WO-2009/035541 A1 | 3/2009 | |
| WO | WO-2010/042877 A1 | 4/2010 | |
| WO | WO-2010/053572 A2 | 5/2010 | |
| WO | WO-2010/084371 A1 | 7/2010 | |
| WO | WO-2010/138652 A1 | 12/2010 | |
| WO | WO-2010/138659 A1 | 12/2010 | |
| WO | WO-2010/138685 A1 | 12/2010 | |
| WO | WO-2010/138695 A1 | 12/2010 | |
| WO | WO-2010/138706 A1 | 12/2010 | |
| WO | WO-2010/138758 A1 | 12/2010 | |
| WO | WO-2011/068810 A1 | 6/2011 | |
| WO | WO-2011/075656 A1 | 6/2011 | |
| WO | WO-2011/127255 A1 | 10/2011 | |
| WO | WO-2012/099755 A1 | 7/2012 | |
| WO | WO-2012/170889 A1 | 12/2012 | |
| WO | WO-2012/170930 A1 | 12/2012 | |
| WO | WO-2013/012476 A2 | 1/2013 | |
| WO | WO-2013/076509 A1 | 5/2013 | |
| WO | WO-2013/118878 A1 | 8/2013 | |
| WO | WO-2013/149140 A1 | 10/2013 | |
| WO | WO-2014/144871 A1 | 9/2014 | |
| WO | WO-2014/186334 A1 | 11/2014 | |
| WO | WO-2014/193857 A1 | 12/2014 | |
| WO | WO-2015/034925 A1 | 3/2015 | |
| WO | WO-2015/095340 A1 | 6/2015 | |
| WO | WO-2015/130584 A2 | 9/2015 | |
| WO | WO-2016/020373 A1 | 2/2016 | |
| WO | WO-2016/197121 A1 | 12/2016 | |
| WO | WO-2017/046203 A1 | 3/2017 | |
| WO | WO-2017/049245 A2 | 3/2017 | |
| WO | WO-2017/055487 A2 | 4/2017 | |
| WO | WO-2017/059357 A1 | 4/2017 | |
| WO | WO-2017/099823 A1 | 6/2017 | |
| WO | WO-2017/112865 A1 | 6/2017 | |
| WO | WO-2017/118734 A1 | 7/2017 | |
| WO | WO-2017/172698 A1 | 10/2017 | |
| WO | WO-2017/185054 A1 | 10/2017 | |
| WO | WO-2017/201332 A1 | 11/2017 | |
| WO | WO-2017/201333 A1 | 11/2017 | |
| WO | WO-2017/201340 A2 | 11/2017 | |
| WO | WO-2017/201342 A1 | 11/2017 | |
| WO | WO-2017/201346 A1 | 11/2017 | |
| WO | WO-2017/201348 A1 | 11/2017 | |
| WO | WO-2017/201349 A1 | 11/2017 | |
| WO | WO-2017/201350 A1 | 11/2017 | |
| WO | WO-2017/222911 A1 | 12/2017 | |
| WO | WO-2018/144775 A1 | 8/2018 | |
| WO | WO-2018/157009 A1 | 8/2018 | |
| WO | WO-2018/170260 A1 | 9/2018 | |
| WO | WO-2018/170306 A1 | 9/2018 | |
| WO | WO-2018/191722 A1 | 10/2018 | |
| WO | WO-2018/222890 A1 | 12/2018 | |
| WO | WO-2018/237372 A1 | 12/2018 | |
| WO | WO-2019/067999 A1 | 4/2019 | |
| WO | WO-2019/089828 A1 | 5/2019 | |
| WO | WO-2019/118919 A1 | 6/2019 | |
| WO | WO-2019/152557 A1 | 8/2019 | |
| WO | WO-2019/152848 A1 | 8/2019 | |
| WO | WO-2019/191780 A1 | 10/2019 | |
| WO | WO-2019/213308 A1 | 11/2019 | |
| WO | WO-2019/222275 A2 | 11/2019 | |
| WO | WO-2019/236673 A1 | 12/2019 | |
| WO | WO-2020/010242 A1 | 1/2020 | |
| WO | WO-2020/023595 A1 | 1/2020 | |
| WO | WO-2020/035070 A1 | 2/2020 | |
| WO | WO-2020061367 A1 | 3/2020 | |
| WO | WO-2020/198403 A2 | 10/2020 | |
| WO | WO-2020237227 A1 * | 11/2020 | A61K 35/17 |
| WO | WO-2020/252436 A1 | 12/2020 | |
| WO | WO-2021/041541 A1 | 3/2021 | |
| WO | WO-2021/055849 A1 | 3/2021 | |
| WO | WO-2021113777 A2 * | 6/2021 | A61K 31/7105 |
| WO | WO-2022261490 A2 * | 12/2022 | C12N 15/79 |

OTHER PUBLICATIONS

Barrett et al. "Circular RNAs: analysis, expression and potential functions," Development, 2016, 1143(11):1838-47.

(56) References Cited

OTHER PUBLICATIONS

Behr et al. "Efficient gene transfer into mammalian primary endocrine cells with lipopolyamine-coated DNA," PNAS 1989, 86(18):6982-6986.
Bloomfield. "Quasi-Elastic Light Scattering Applications in Biochemistry and Biology," Ann. Rev. Biophys. Bioeng., 1981, 10:421-50.
Bohjanen, et al., "A small circular TAR RNA decoy specifically inhibits Tat-activated HIV-1 transcription,", Nucleic Acids Res., 1996, 24(19):3733-8.
Bohjanen, et al., "TAR RNA decoys inhibit Tat-activated HIV-1 transcription after preinitiation complex formation", Nucleic Acids Res., 1997, 25(22): 4481-6.
Borchardt et al. "Inducing circular RNA formation using the CRISPR endoribonuclease Csy4," RNA, 2017, 23(5):619-627.
Branch et al. "Unusual properties of two branched RNA's with circular and linear components," Nucleic Acids Res., 1985, 13(13):4889-903.
Bricogne. "[23] Bayesian statistical viewpoint on structure determination: Basic concepts and examples," Methods Enzymol, 1997, 276:361-423.
Bricogne. "Direct phase determination by entropy maximization and likelihood ranking: status report and perspectives," Acta Crystallogr D Biol Crystallogr, 1993, 49(Pt 1):37-60.
Brown et al. "Biophotonic cytotoxicity assay for high-throughput screening of cytolytic killing," J Immunol Methods, 2005, 297(1-2):39-52.
Budker et al. "Protein/Amphipathic Polyamine Complexes Enable Highly Efficient Transfection with Minimal Toxicity," BioTechniques, 1997, 23:139-147.
Cao et al. "Development and application of a multiplexable flow cytometry-based assay to quantify cell-mediated cytolysis," Cytometry A, 2010, 77(6):534-45.
Caplen et al. "In vitro liposome-mediated DNA transfection of epithelial cell lines using the cationic liposome DC-Chol/DOPE," Gene Ther, 1995, 2(9):603-13.
Carmona, Ellese Marie. 2019. Circular RNA: Design Criteria for Optimal Therapeutical Utility. Doctoral dissertation, Harvard University, Graduate School of Arts & Sciences.
Cech, "Self-Splicing of Group 1 Introns," Annu Rev Biochem., 1990, 59:543-68.
Chayen. "The role of oil in macromolecular crystallization," Structure, 1997, 5(10):1269-74.
Chen and Sarnow, "Initiation of protein synthesis by the eukaryotic translational apparatus on circular RNAs," Science. 1995, 268(5209):415-417.
Chen et al. "Promising diagnostic and therapeutic circRNAs for skeletal and chondral disorders," Int J Biol Sci., 2021, 17(5):1428-1439.
Chen et al. "Sensing Self and Foreign Circular RNAs by Intron Identify," Molecular Cell, 2017, 67:228-238.
Cheung et al. "Epitope-specific antibody response to the surface antigen of duck hepatitis B virus in infected ducks," Virology, 1990, 176(2):546-52.
Chothia et al. "Canonical structures for the hypervariable regions of immunoglobulins," J Mol Biol, 1987, 196(4):901-17.
Chothia et al. "Structural repertoire of the human VH segments," J Mol Biol, 1992, 227(3):799-817.
Costello et al. "Reinventing the Wheel: Synthetic Circular RNAs for Mammalian Cell Engineering." Trends Biotechnol., 2020, 38(2):217-230.
Dahlman et al., "Barcoded nanoparticles for high throughput in vivo discovery of targeted therapeutics," Proc Natl Acad Sci U S A. 2017, 114(8):2060-2065.
Devaux et al., "Circular RNAs in heart failure", Eur J Heart Fail. 2017, 19(6):701-709.
Dobrikova et al. "Activity of a type 1 picornavirus internal ribosomal entry site is determined by sequences within the 3? nontranslated region," PNAS, 2003, 100(25):15125-15130.

Dong et al. "Lipopeptide nanoparticles for potent and selective siRNA delivery in rodents and nonhuman primates," PNAS, 2014, 111(11):3955-3960.
Durymanov and Reineke, "Non-viral Delivery of Nucleic Acids: Insight Into Mechanisms of Overcoming Intracellular Barriers," Front Pharmacol. 2018, 9:971.
Eastwood et al. "Monoclonal antibody TGN1412 trial failure explained by species differences in CD28 expression on CD4+ effector memory T-cells," Br J Clin Pharmacol, 2010, 161(3):512-526.
Eastwood et al. "Severity of the TGN1412 trial disaster cytokine storm correlated with IL-2 release," Br J Clin Pharmacol, 2013, 76(2): 299-315.
Edge et al. "Total synthesis of a human leukocyte interferon gene," Nature, 1981, 292(5825):756-62.
Examination Report issued in EP19739422.4 dated Mar. 17, 2022. 6 pages.
Felgner et al. "Lipofection: A highly efficient, lipid-mediated DNA-transfection procedure," PNAS, 1987, 84:7413-7417.
Fenton et al., "Customizable Lipid Nanoparticle Materials for the Delivery of siRNAs and mRNAs," Angew Chem Int Ed Engl. 2018, 57(41):13582-86.
Final Office Action for U.S. Appl. No. 16/432,177, mailed Apr. 25, 2023.
Final Office Action for U.S. Appl. No. 17/191,697, mailed Sep. 30, 2021.
Final Office Action for U.S. Appl. No. 17/384,460, mailed Jul. 22, 2022.
Final Office Action for U.S. Appl. No. 17/503,208, mailed Aug. 30, 2022.
Final Office Action for U.S. Appl. No. 17/548,241, mailed Sep. 28, 2022.
Final Office Action for U.S. Appl. No. 17/202,223, mailed Mar. 7, 2022.
Final Office Action for U.S. Appl. No. 17/202,223, mailed Nov. 2, 2022.
Finney et al. "Chimeric receptors providing both primary and costimulatory signaling in T cells from a single gene product," J Immunol, 1998, 161(6):2791-7.
Ford et al. "Synthesis of circular RNA in bacteria and yeast using RNA cyclase ribozymes derived from a group I intron of phage T4," PNAS, 1994, 91:3117-3121.
Foster et al. "Purification of mRNA Encoding Chimeric Antigen Receptor Is Critical for Generation of a Robust T-Cell Response," Hum Gene Ther, 2019, 30(2):168-178.
Gao et al. "A novel cationic liposome reagent for efficient transfection of mammalian cells," Biochem Biophys Res Commun, 1991, 179(1):280-5.
Garlapati et al. "Identification of a novel internal ribosome entry site in giardiavirus that extends to both sides of the initiation codon," J Biol Chem, 2004, 279(5):3389-97.
Giegé et al. "Crystallogenesis of biological macromolecules: facts and perspectives," Acta Crystallogr D Biol Crystallogr, 1994, 50(Pt 4):339-50.
Greene et al., "Circular RNAs: Biogenesis, Function and Role in Human Diseases," Front Mol Biosci. 2017, 4:38.
Gross et al. "Therapeutic Potential of T Cell Chimeric Antigen Receptors (CARs) in Cancer Treatment: Counteracting Off-Tumor Toxicities for Safe CAR T Cell Therapy," Annu Rev Pharmacol Toxicol, 2016, 56:59-83.
Gurtu et al. "IRES bicistronic expression vectors for efficient creation of stable mammalian cell lines," Biochem Biophys Res Commun, 1996, 229(1):295-8.
Han et al. "Multi-antigen-targeted chimeric antigen receptor T cells for cancer therapy," J Hematol Oncol., 2019, 12(1):128.
Harrer et al. "RNA-transfection of gamma/delta T cells with a chimeric antigen receptor or an alpha/beta T-cell receptor: a safer alternative to genetically engineered alpha/beta T cells for the immunotherapy of melanoma," BMC Cancer, 2017, 17:551, 17 pages.
He et al. "Circular RNAs and cancer", Cancer Lett . 2017, 396:138-144.

(56) References Cited

OTHER PUBLICATIONS

Heyes et al. "Cationic lipid saturation influences intracellular delivery of; encapsulated nucleic acids," Journal of Controlled Release, 2005, 107:276-287.
Holdt et al. "Circular RNAs as Therapeutic Agents and Targets," Front Physiol., 2018, 9:1262.
International Preliminary Report on Patentability and Written Opinion for International Application No. PCT/US2019/035531, mailed Dec. 8, 2020, 8 pages.
International Preliminary Report on Patentability for International Application No. PCT/US2020/034418, mailed Nov. 16, 2021, 8 pages.
International Search Report and Written Opinion for International Application No. PCT/US2019/035531, mailed Sep. 27, 2019, 13 pages.
International Search Report and Written Opinion for International Application No. PCT/US2020/034418, mailed Sep. 28, 2020, 15 pages.
International Search Report and Written Opinion for International Application No. PCT/US2020/063494, mailed Aug. 6, 2021, 24 pages.
International Search Report and Written Opinion for International Application No. PCT/US2021/023540, mailed Oct. 11, 2021, 30 pages.
International Search Report and Written Opinion for International Application No. PCT/US2021/031629, mailed Feb. 4, 2022, 24 pages.
International Search Report and Written Opinion for International Appliction No. PCT/US2021/033276, mailed Oct. 18, 2021, 34 pages.
Jay. "A general procedure for the end labeling of proteins and positioning of amino acids in the sequence," J Biol Chem, 1984, 259(24):15572-8.
Jayaraman et al. "Polymerase chain reaction-mediated gene synthesis: synthesis of a gene coding for isozyme c of horseradish peroxidase," PNAS, 1991, 88(10):4084-8.
Jeck et al. "Detecting and characterizing circular RNAs," Nat Biotechnol., 2014, 32(5):453-61.
Jemielity et al. "Synthetic mRNA cap analogs with a modified triphosphate bridge—synthesis, applications and prospects," New Journal of Chemistry, 2010, 34:829-844.
Kabat et al. "Attempts to locate complementarity-determining residues in the variable positions of light and heavy chains," Annals of the New York Academy of Sciences, 1971, 190(1):382-393.
Kaczmarek et al. "Advances in the Delivery of RNA Therapeutics: from Concept to Clinical Reality," Genome Medicine, 2017, 9(1):60.
Kalos et al. "T Cells with Chimeric Antigen Receptors Have Potent Antitumor Effects and Can Establish Memory in Patients with Advanced Leukemia," Sci Transl Med, 2011, 3:95.
Kariko et al., "Generating the optimal mRNA for therapy: HPLC purification eliminates immune activation and improves translation of nucleoside-modified, protein-encoding mRNA," Nucleic Acids Res. 2011, 39(21):e142.
Kariko et al., "Incorporation of Pseudouridine Into mRNA Yields Superior Nonimmunogenic Vector With Increased Translational Capacity and Biological Stability," Mol Ther. 2008, 16(11):1833-40.
Kauffman et al. "Optimization of Lipid Nanoparticle Formulations for mRNA Delivery in Vivo with Fractional Factorial and Definitive Screening Designs," Nano Lett, 2015, 15(11):7300-6.
Kauffman et al., "Efficacy and Immunogenicity of Unmodified and Pseudouridine-Modified mRNA Delivered Systemically with Lipid Nanoparticles in Vivo," Biomaterials, 2016, 109:78-87.
Kauffman et al., "Rapid, Single-cell Analysis and Discovery of Vectored mRNA Transfection in Vivo wth a loxP-Flanked tdTomato Reporter Mouse," Molecular Therapy: Nucleic Acids, 2018, 10:55-63.
Kauffman, "Optimization and analysis of lipid nanoparticles for in vivo mRNA delivery," Ph.D. Thesis, Massachusetts Institute of Technology, Department of Chemical Engineering, 2017, 167 pages.
Kaufman et al. "Improved vectors for stable expression of foreign genes in mammalian cells by use of the untranslated leader sequence from EMC virus," Nucleic Acids Res, 1991, 19(16):4485-90.
Kirkland et al. "Analysis of the fine specificity and cross-reactivity of monoclonal anti-lipid A antibodies," J Immunol, 1986, 137(11):3614-9.
Klibanov et al. "Amphipathic polyethyleneglycols effectively prolong the circulation time of liposomes," FEBS Lett., 1990, 268(1):235-7.
Kobayashi et al. "Improved dicistronic mRNA expression vectors for efficient selection of transfectants highly expressing foreign genes," Biotechniques, 1996, 21(3):398-402.
Koos et al. "Influence of structure on antimicrobial activity of some heterocycles. IV. 1-(3-alkylamino-2-hydroxypropyl)-2-methyl-5-nitroimidazoles," Chem Papers. 1994, 48(1):54-57.
Kotterman and Schaffer. "Engineering adeno-associated viruses for clinical gene therapy," Nat Rev Genet. 2014, 15(7):445-51.
Krause et al. "Antigen-dependent CD28 signaling selectively enhances survival and proliferation in genetically modified activated human primary T lymphocytes," J Exp Med., 1998, 188(4):619-26.
Lasic et al. "Gelation of liposome interior. A novel method for drug encapsulation," FEBS Lett, 1992, 312(2-3):255-8.
Lasic. "Novel applications of liposomes," Trends Biotechnol, 1998, 16(7):307-21.
Legnini et al., "Circ-ZNF609 Is a Circular RNA that Can Be Translated and Functions in Myogenesis," Mol Cell. 2017, 66(1):22-37.
Lenzi et al., "Gene Transfer Research: The Evolution of the Clinical Science," National Academies Press (US), 2014. Available from: https://www.ncbi.nlm.nih.gov/books/NBK195893/.
Li et al. "In vivo gene transfer via intravenous administration of cationic lipid-protamine-DNA (LPD) complexes," Gene Ther, 1997, 4(9):891-900.
Li et al. "The Biogenesis, Functions, and Challenges of Circular RNAs," Mol Cell., 2018, 71(3):428-442.
Liang et al. "Short intronic repeat sequences facilitate circular RNA production," Genes & Development, 2014, 28:2233-2247.
Liang et al. "The Output of Protein-Coding Genes Shifts to Circular RNAs When the Pre-mRNA Processing Machinery Is Limiting," Molecular Cell, 2017, 68:940-954.
Litke et al. "Trans ligation of RNAs to generate hybrid circular RNAs using highly efficient autocatalytic transcripts," Methods, 2021, S1046-2023(21)00135-3.
Mangraviti et al. "Polymeric nanoparticles for nonviral gene therapy extend brain tumor survival in vivo," ACS Nano, 2015, 9(2):1236-49.
Mao et al. "Biological roles and therapeutic potential of circular RNAs in osteoarthritis," Mol Ther Nucleic Acids, 2021, 24:856-867.
McPherson. "Crystallization of proteins from polyethylene glycol," J Biol Chem., 1976, 251(20):6300-3.
McPherson. "Current approaches to macromolecular crystallization," Eur J Biochem., 1990, 189(1):1-23.
Meganck et al. "Engineering highly efficient backsplicing and translation of synthetic circRNAs," Mol Ther Nucleic Acids, 2021, 23:821-834.
Memczak et al., "Circular RNAs and a large class of animal RNAs with regulatory potency," 2013, 495:333-338.
Merten et al. "Production of lentiviral vectors," Mol Ther, 2016, 3:16017.
Metzgar et al. "Abrupt emergence of diverse species B adenoviruses at US military recruit training centers," J Infect Dis. 2007, 196(10):1465-73.
Moldenhauer et al. "Identity of HML-1 antigen on intestinal intraepithelial T cells and of B-ly7 antigen on hairy cell leukaemia," Scand. J. Immunol., 1990, 32(2):77-82.
Morel et al. "Monoclonal antibodies to bovine serum albumin: Affinity and specificity determinations," Mol Immunol, 1988, 25(1):7-15.
Morrissey et al. "Potent and persistent in vivo anti-HBV activity of chemically modified siRNAs," Nat Biotechnol, 2005, 23(8):1002-7.

(56) References Cited

OTHER PUBLICATIONS

Mosser et al. "Use of a dicistronic expression cassette encoding the green fluorescent protein for the screening and selection of cells expressing inducible gene products," Biotechniques, 1997, 22(1):150-4, 156, 158-61.
Mu et al., "An origin of the immunogenicity of in vitro transcribed RNA," Nucleic Acids Res. 2018, 46(10):5239-5249.
Nakamoto et al. "Chemical Synthesis of Circular RNAs with Phosphoramidate Linkages for Rolling-Circle Translation," Curr Protoc., 2021, 1(3):e43.
Nambiar et al. "Total synthesis and cloning of a gene coding for the ribonuclease S protein," Science, 1984, 223(4642):1299-301.
Non-Final Office Action for U.S. Appl. No. 16/432,177, mailed Oct. 3, 2022.
Non-Final Office Action for U.S. Appl. No. 17/191,697, mailed Jun. 18, 2021.
Non-Final Office Action for U.S. Appl. No. 17/374,497, mailed Dec. 7, 2021.
Non-Final Office Action for U.S. Appl. No. 17/468,100, mailed Dec. 8, 2021.
Non-Final Office Action for U.S. Appl. No. 17/492,512, mailed Mar. 1, 2022.
Non-Final Office Action for U.S. Appl. No. 17/894,141, mailed Jan. 18, 2023.
Non-Final Office Action for U.S. Appl. No. 17/202,223, mailed Apr. 18, 2022.
Non-Final Office Action for U.S. Appl. No. 17/202,223, mailed Aug. 20, 2021.
Non-Final Office Action for U.S. Appl. No. 17/384,460, mailed Dec. 23, 2022.
Non-Final Office Action for U.S. Appl. No. 17/384,460, mailed Mar. 24, 2022.
Non-Final Office Action for U.S. Appl. No. 17/503,208, mailed May 5, 2022.
Non-Final Office Action for U.S. Appl. No. 17/548,241, mailed May 24, 2022.
Non-Final Office Action for U.S. Appl. No. 17/548,247, mailed Apr. 1, 2022.
Notice of Allowance for U.S. Appl. No. 17/202,223, mailed Mar. 2, 2023.
Notice of Allowance for U.S. Appl. No. 17/202,223, mailed Nov. 16, 2022.
Notice of Allowance for U.S. Appl. No. 17/503,208, mailed Jan. 19, 2023.
Notice of Allowance for U.S. Appl. No. 17/548,241, mailed Feb. 27, 2023.
Notice of Allowance for U.S. Appl. No. 17/548,241, mailed Mar. 31, 2023.
Notice of Allowance for U.S. Appl. No. 17/548,241, mailed May 22, 2023.
Notice of Allowance for U.S. Appl. No. 17/548,247, mailed Nov. 14, 2022.
Notice of Allowance for U.S. Appl. No. 17/191,697, mailed Nov. 2, 2021.
Notice of Allowance for U.S. Appl. No. 17/374,497, mailed Apr. 13, 2022.
Notice of Allowance for U.S. Appl. No. 17/374,497, mailed May 4, 2022.
Notice of Allowance for U.S. Appl. No. 17/384,460, mailed Jun. 13, 2023.
Notice of Allowance for U.S. Appl. No. 17/468,100, mailed Apr. 8, 2022.
Notice of Allowance for U.S. Appl. No. 17/468,100, mailed May 3, 2022.
Notice of Allowance for U.S. Appl. No. 17/492,512, mailed Apr. 26, 2022.
Notice of Allowance for U.S. Appl. No. 17/548,247, mailed Jul. 22, 2022.
Oberli et al. "Lipid Nanoparticle Assisted mRNA Delivery for Potent Cancer Immunotherapy," Nano Letters, 2017, 17:1326-1335.
Obi et al. "The design and synthesis of circular RNAs," Methods, 2021, S1046-2023(21)00065-7.
Ochi et al., "Non-enzymatic in vitro production of circular hammerhead ribozyme targeting the template region of human telomerase RNA," Nucleic Acids Symp Ser (Oxf). 2009, 53:275-276.
Pamudurti et al., "Translation of CircRNAs," Mol Cell. 2017, 66(1):9-21.
Petkovic et al. "RNA circularization strategies in vivo and in vitro," Nucleic Acids Res. 2015, 43(4):2454-65.
Porter et al. "Chimeric antigen receptor-modified T cells in chronic lymphoid leukemia," N Engl J Med, 2011, 365(8):725-33.
Presolski et al. "Copper-Catalyzed Azide-Alkyne Click Chemistry for Bioconjugation," Curr Protoc Chem Biol, 2011, 3(4):153-162.
Puttaraju and Been, "Circular Ribozymes Generated in *Escherichia coli* Using Group I Self-splicing Permuted Intron-Exon Sequences," J. Biol. Chem., 1996, 271(42):26081-87.
Puttaraju et al. "Group I Permuted Intron-exon (PIE) Sequences Self-splice to Produce Circular Exons," Nucleic Acids Research, 1992, 20(20):5357-5364.
Queen et al. "a humanized antibody that binds to the interleukin 2 receptor," PNAS, 1989, 86:10029-10033.
Rafiq et al. "Targeted delivery of a PD-1-blocking scFv by CAR-T cells enhances anti-tumor efficacy in vivo," Nat Biotechnol., 2018, 36(9):847-856.
Ramesh et al. "High-titer bicistronic retroviral vectors employing foot-and-mouth disease virus internal ribosome entry site," Nucleic Acids Res, 1996, 24(14):2697-700.
Rausch et al. "Characterizing and circumventing sequence restrictions for synthesis of circular RNA in vitro," Nucleic Acids Res., 2021, 49(6):e35.
Rees et al. "Bicistronic vector for the creation of stable mammalian cell lines that predisposes all antibiotic-resistant cells to express recombinant protein," Biotechniques, 1996, 20(1):102-4, 106, 108-10.
Riechmann et al. "Reshaping human antibodies for therapy," Nature, 1988, 332(6162):323-7.
Roversi et al. "Modelling prior distributions of atoms for macromolecular refinement and completion," Acta Crystallogr D Biol Crystallogr, 2000, 56(Pt 10):1316-23.
Sahin et al., "mRNA-based therapeutics—developing a new class of drugs," Nat Rev Drug Discov. 2014, 13(10):759-80.
Semple et al. "Rational design of cationic lipids for siRNA delivery," Nat Biotechnol, 2010, 28(2):172-6.
Shim et al., "Nonviral Delivery Systems for Cancer Gene Therapy: Strategies and Challenges," Curr Gene Ther. 2018, 18(1):3-20.
Shobaki et al. "Mixing lipids to manipulate the ionization status of lipid nanoparticles for specific tissue targeting," Int J Nanomedicine, 2018, 13:8395-8410.
Song et al. "CD27 costimulation augments the survival and antitumor activity of redirected human T cells in vivo," Blood, 2012, 119(3):696-706.
Starke et al. "Exon Circularization Requires Canonical Splice Signals," Cell Reports, 2015, 10:103-111.
STN Registry Database Entry for 1333432-38-4 entered STN Sep. 27, 2011.
STN Registry Database Entry for 1333626-46-2 entered STN Sep. 28, 2011.
STN Registry Database Entry for 156811-31-3 entered STN Aug. 5, 1994.
STN Registry Database Entry for 157493-54-4 entered STN Sep. 7, 1994.
STN Registry Database Entry for 1609534-48-6 entered STN Jun. 4, 2014.
STN Registry Database Entry for 2086785-24-0 entered STN Mar. 17, 2017.
STN Registry Database Entry for 2086785-25-1 entered STN Mar. 17, 2017.
STN Registry Database Entry for 2086785-26-2 entered STN Mar. 17, 2017.
STN Registry Database Entry for 2086785-27-3 entered STN Mar. 17, 2017.
STN Registry Database Entry for 2086785-32-0 entered STN Mar. 17, 2017.

(56) References Cited

OTHER PUBLICATIONS

STN Registry Database Entry for 2086785-33-1 entered STN Mar. 17, 2017.
STN Registry Database Entry for 2089251-16-9 entered STN Apr. 10, 2017.
STN Registry Database Entry for 79111-60-7 entered STN Nov. 16, 1984.
Structures of lipids from Benenato et al., Ciaramella et al., Huang et al., and Benenato et al. (28 pages).
Stähli et al. "Distinction of epitopes by monoclonal antibodies," Methods Enzymol, 1983, 92:242-53.
Sullenger et al. "From the RNA world to the clinic," Science, 2016, 352(6292):1417-1420.
Szoka et al. "Comparative properties and methods of preparation of lipid vesicles (liposomes)," Annu Rev Biophys Bioeng, 1980, 9:467-508.
Tramontano et al. "Framework residue 71 is a major determinant of the position and conformation of the second hypervariable region in the VH domains of immunoglobulins," J Mol Biol, 1990, 215(1):175-82.
Umekage et al. "In vivo circular RNA production using a constitutive promoter for high-level expression," J Biosci Bioeng, 2009, 108(4):354-6.
Umekage et al., "In Vivo Circular RNA Expression by the Permuted Intron-Exon Method," InTech, 2012, 17 pages.
Unpublished U.S. Appl. No. 17/996,074, entitled "Circular RNA Compositions and Methods," filed Oct. 12, 2022; Inventors: Robert Alexander Wesselhoeft and Brian Goodman.
Unpublished U.S. Appl. No. 17/999,378, entitled "Circular RNA Compositions and Methods," filed Nov. 18, 2022; Inventors: Robert Alexander Wesselhoeft, Thomas Barnes, Brian Goodman, Gregory Motz, Amy M. Becker, and Allen T. Horhota.
Unpublished U.S. Appl. No. 18/069,621, entitled "Circular RNA Compositions and Methods," filed Dec. 21, 2022; Inventors: Robert Alexander Wesselhoeft, Daniel G. Anderson, Shinichiro Fuse, Brian Goodman, Allen T. Horhota, and Raffaella Squilloni.
Unpublished U.S. Appl. No. 18/320,126, entitled "Circular RNA Compositions and Methods," filed May 18, 2023; Inventors: Brian Goodman, Robert Alexander Wesselhoeft, Allen T. Horhota, Junghoon Yang.
Valdmanis and Kay, "The Expanding Repertoire of Circular RNAs," Mol Ther. 2013, 21(6):1112-4.
Van Esch et al. "Aggregation behavior and copper-binding properties of surfactants containing imidazole and pyrazole ligands," Recl Trav Chim Pays-Bas. 1994, 113(4):186-193.
Verhoeyen et al. "Reshaping human antibodies: grafting an antilysozyme activity," Science, 1988, 239(4847):1534-6.
Vessillier et al. "Cytokine release assays for the prediction of therapeutic mAb safety in first-in man trials—Whole blood cytokine release assays are poorly predictive for TGN1412 cytokine storm," J Immunol Methods, 2015, 424:43-52.
Wadhwa et al. "Receptor mediated glycotargeting," J Drug Target, 1995, 3(2):111-27.
Wang and Wang, "Efficient backsplicing produces translatable circular mRNAs," RNA, 2015, 21(2):172-179.
Wang et al. "Combinatorially designed lipid-like nanoparticles for intracellular delivery of cytotoxic protein for cancer therapy," Angew Chem Int Ed Engl. 2014, 53(11):2893-2898.
Wesselhoeft et al. "Engineering Circular RNA for Potent and Stable Translation in Eukaryotic Cells," Nature Communications, 2018, 9(1):2629, 10 pages.
Wesselhoeft et al. "RNA Circulation Diminishes Immunogenicity and can Extend Translation Duration In Vivo," Molecular Cell, 2019, 74(3):508-520.
Wiesinger et al. "Clinical-Scale Production of CAR-T Cells for the Treatment of Melanoma Patients by mRNA Transfection of a CSPG4-Specific CAR under Full GMP Compliance," Cancers (Basel), 2019, 11(8):1198.
Xue et al. "Lipid-based nanocarriers for RNA delivery," Curr Pharm Des, 2015, 21(22):3140-7.
Yang et al. "Circular RNAs: Expression, localization, and therapeutic potentials," Mol Ther, 2021, 29(5):1683-1702.
Yang et al., "Decay Rates of Human mRNAs: Correlation with Functional Characteristics and Sequence Attributes," Genome Res. 2003, 13(8):1863-72.
Yeku et al. "Armored CAR T-cells: utilizing cytokines and pro-inflammatory ligands to enhance CAR T-cell anti-tumour efficacy," Biochem Soc Trans, 2016, 44(2):412-8.
Zeng et al., "A Circular RNA Binds to and Activates AKT Phosphorylation and Nuclear Localization Reducing Apoptosis and Enhancing Cardia Repair," Theranostics, 2017, 7(16):3842-3855.
Zhang et al. "A novel protein encoded by the circular form of the SHPRH gene suppresses glioma tumorigenesis," Oncogene, 2018, 37(13):1805-1814.
International Search Report and Written Opinion for International Patent Application No. PCT/US2023/068812, mailed Oct. 20, 2023.
Xin, Y., et al., "Developing a Novel Anti-BCina CAR-T for Relapsed or Refractory Multiple Myeloma", Blood, American Society of Hematology, 134:50, Nov. 13, 2019.
Taewoong, C., et al., "Chimeric antigen receptor (CAR) T-cell therapy for multiple myeloma", Pharmacology & Therapeutics, 232:1-9, Apr. 1, 2022.
Barrett, D.M., et al., "Chimeric Antigen Receptor Therapy for Cancer", Annual Review of Medicine, 65(1):333-347, Jan. 14, 2014.
Sasso, J.M., et al., "The Progress and Promise of RNA Medicine—An Arsenal of Targeted Treatments", Journal of Medicinal Chemistry, 65(10):6975-7015, May 26, 2022.

* cited by examiner

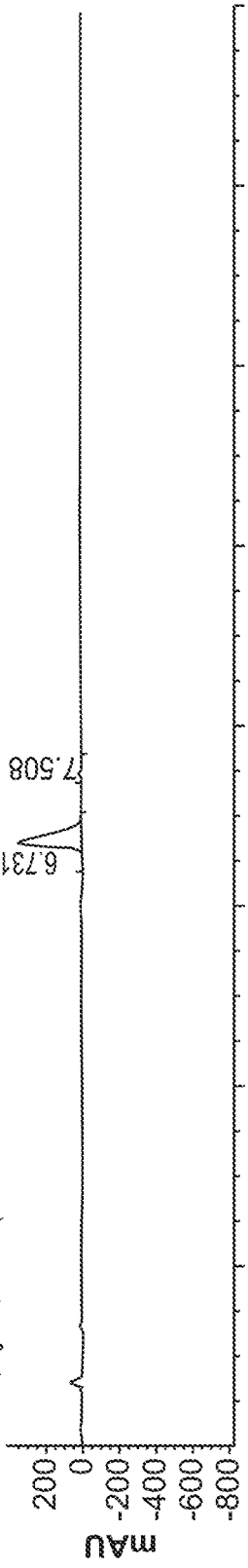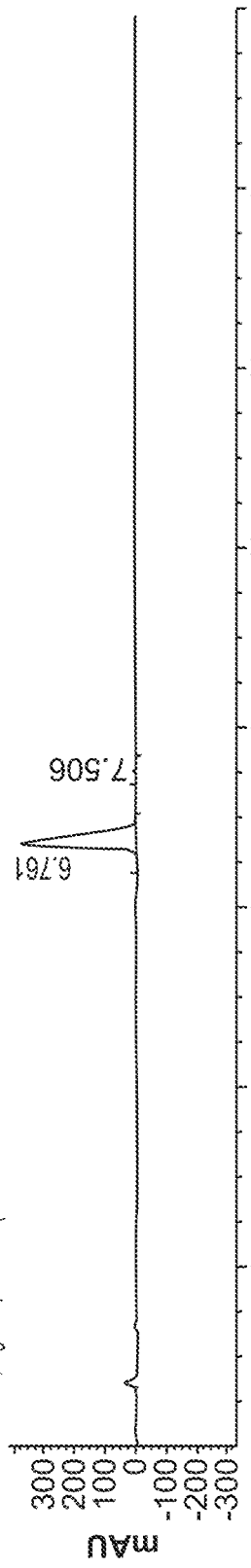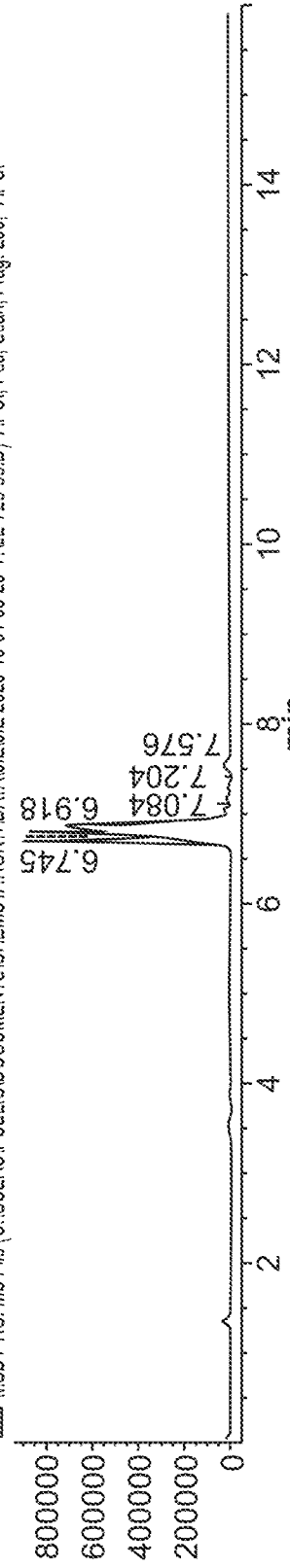
FIG. 31B

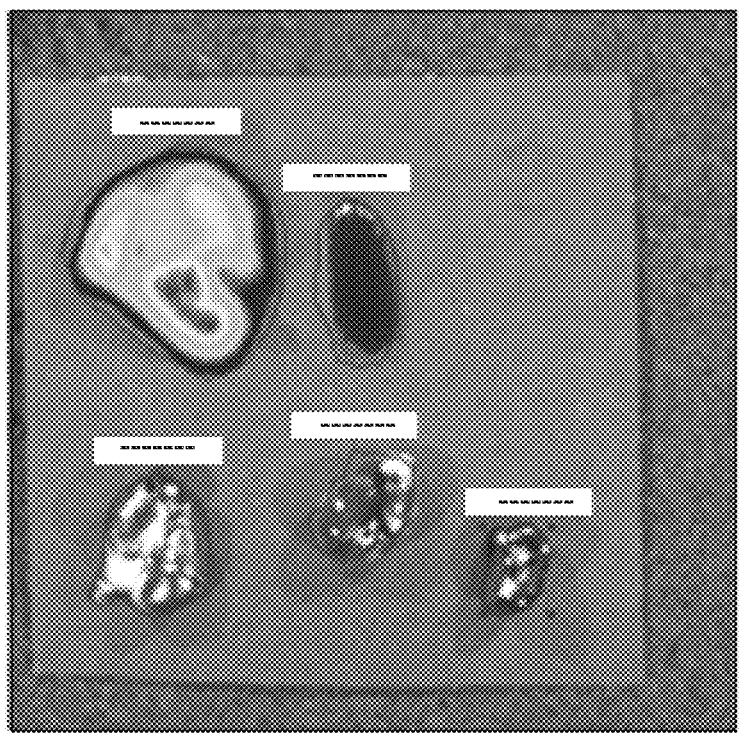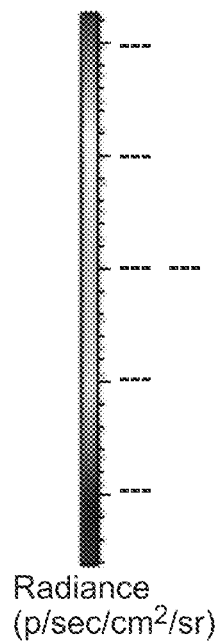
FIG. 36A
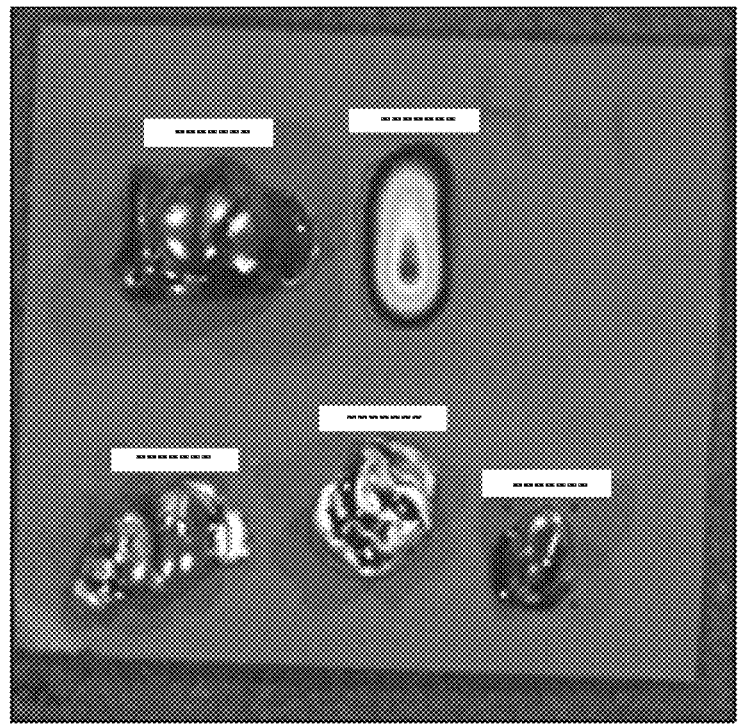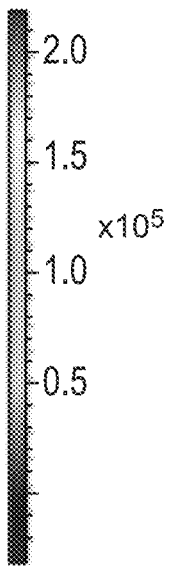
FIG. 36B

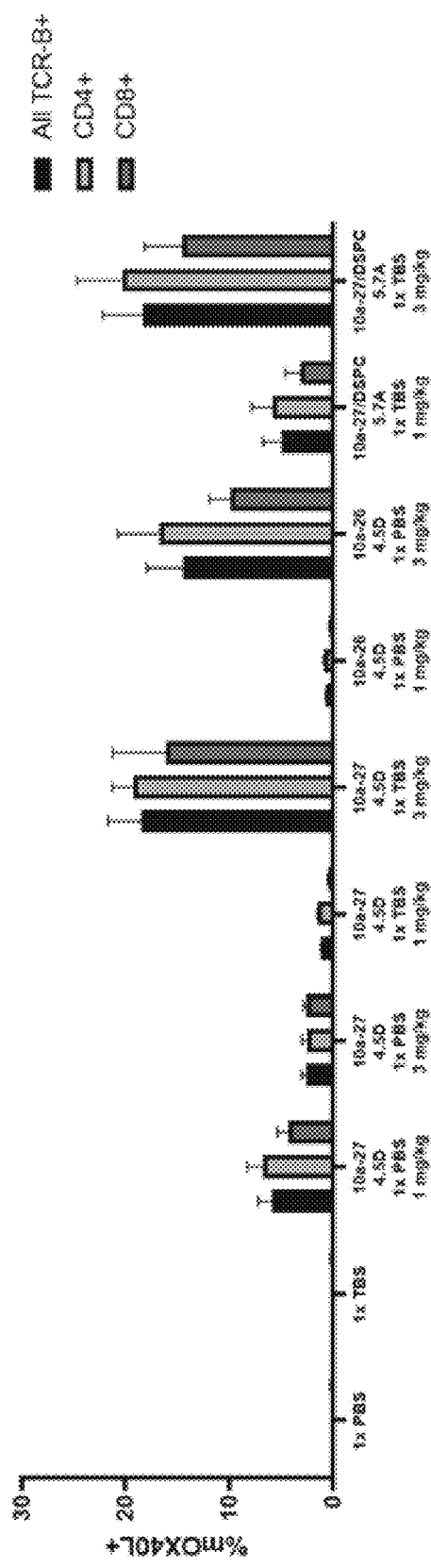
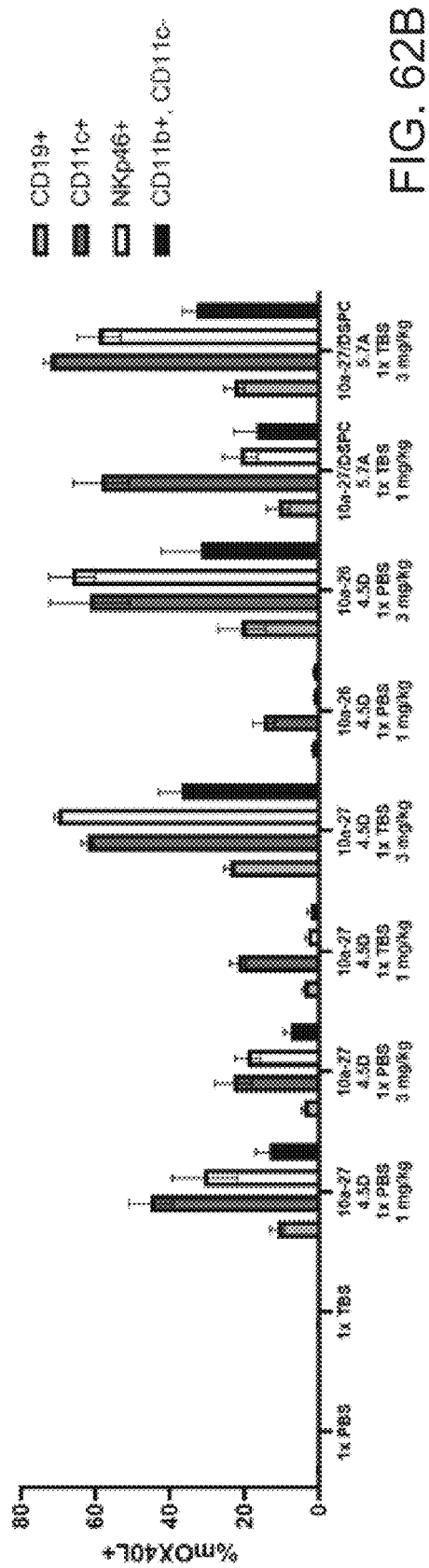

26, 36, 52, 64

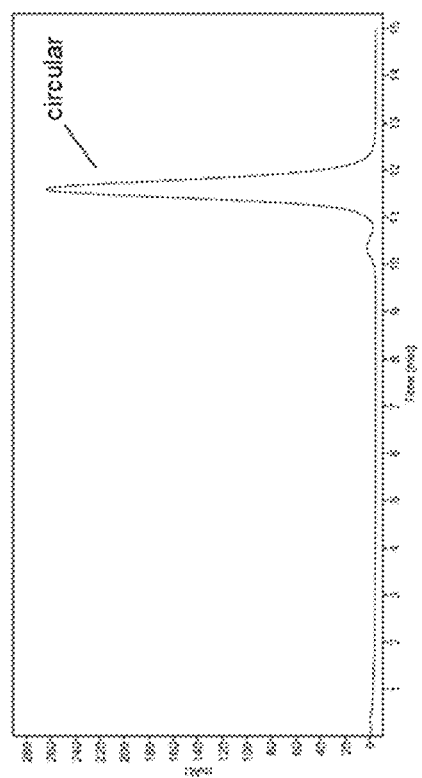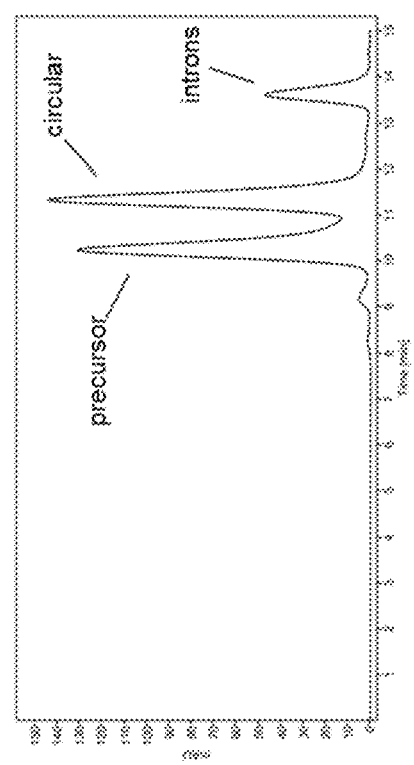
FIG. 99B

CIRCULAR RNA ENCODING CHIMERIC ANTIGEN RECEPTORS TARGETING BCMA

CROSS REFERENCE

This application claims the benefit of priority of U.S. Provisional Application No. 63/355,527, filed on Jun. 24, 2022, the contents of which are hereby incorporated by reference in their entirety for all purposes.

SEQUENCE LISTING

This application contains a Sequence Listing in computer readable form. The computer readable form is incorporated herein by reference. Said ASCII copy, created on Jul. 13, 2023, is named OBS-027_SL.txt and is 3,898,334 bytes in size.

Ascii Table

This patent application contains a lengthy table section. A copy of the tables has been submitted electronically in ASCII format and is hereby incorporated herein by reference in its entirety. Said ASCII tables, are as follows:

(1) Table_A_TRES.txt, 3,228,767 bytes, created Dec. 13, 2022;
(2) Table_B_IRES2.txt, 258,170 bytes, created Dec. 13, 2022;
(3) Table_C_A_Permutation_5_Intron.txt, 11,158 bytes, created Dec. 13, 2022;
(4) Table_D_A_Permutation_for_3_Intron.txt, 11,558 bytes, created Dec. 13, 2022;
(5) Table_E_Non_A_Permutation_5_Intron.txt, 3,925 bytes, created Dec. 13, 2022;
(6) Table_F_Non_A_Permutation_3_Intron.txt, 10,096 bytes, created Dec. 13, 2022;
(7) Table_G_Spacer_and_A_5_Intron.txt, 21,824 bytes, created Dec. 13, 2022;
(8) Table_H_Spacer_and_A_3_Intron.txt, 21,822 bytes, created Dec. 13, 2022;
(9) Table_I_CAR.txt, 23,098 bytes, created Dec. 13, 2022;
(10) Table_J_CAR_Domain.txt, 10,813 bytes, created Dec. 13, 2022;
(11) Table_K_PD1_PDL1.txt, 3,716 bytes, created Dec. 13, 2022;
(12) Table_L_Cytokine.txt, 3,716 bytes, created Dec. 13, 2022;
(13) Table_M_Transcription_Factors.txt, 4,978 bytes, created Dec. 13, 2022;
(14) Table_N_Accessory_Sequence.txt, 3,466 bytes, created Dec. 13, 2022;
(15) Table_O_Stop_Codon.txt, 390 bytes, created Dec. 13, 2022;
(16) Table_P_Immmune_Modulatory_Proteins.txt, 39,276 bytes, created Dec. 13, 2022;
(17) Table_Q_Protein_for_RGD.txt, 61,166 bytes, created Dec. 13, 2022; and
(18) Table_R_Aptamer.txt, 334 bytes, created Dec. 13, 2022.

LENGTHY TABLES

The patent contains a lengthy table section. A copy of the table is available in electronic form from the USPTO web site (https://seqdata.uspto.gov/?pageRequest=docDetail&DocID=US12297285B2). An electronic copy of the table will also be available from the USPTO upon request and payment of the fee set forth in 37 CFR 1.19(b)(3).

BACKGROUND OF THE INVENTION

Conventional gene therapy involves the use of DNA for insertion of desired genetic information into host cells. The DNA introduced into the cell is usually integrated to a certain extent into the genome of one or more transfected cells, allowing for long-lasting action of the introduced genetic material in the host. While there may be substantial benefits to such sustained action, integration of exogenous DNA into a host genome may also have many deleterious effects. For example, it is possible that the introduced DNA will be inserted into an intact gene, resulting in a mutation which impedes or even totally eliminates the function of the endogenous gene. Thus, gene therapy with DNA may result in the impairment of a vital genetic function in the treated host, such as e.g., elimination or deleteriously reduced production of an essential enzyme or interruption of a gene critical for the regulation of cell growth, resulting in unregulated or cancerous cell proliferation. In addition, with conventional DNA based gene therapy it is necessary for effective expression of the desired gene product to include a strong promoter sequence, which again may lead to undesirable changes in the regulation of normal gene expression in the cell. It is also possible that the DNA based genetic material will result in the induction of undesired anti-DNA antibodies, which in turn, may trigger a possibly fatal immune response. Gene therapy approaches using viral vectors can also result in an adverse immune response. In some circumstances, the viral vector may even integrate into the host genome. In addition, production of clinical grade viral vectors is also expensive and time consuming. Targeting delivery of the introduced genetic material using viral vectors can also be difficult to control. Thus, while DNA based gene therapy has been evaluated for delivery of secreted proteins using viral vectors (U.S. Pat. No. 6,066,626; U.S. Publication No. US2004/0110709), these approaches may be limited for these various reasons.

In contrast to DNA, the use of RNA as a gene therapy agent is substantially safer because RNA does not involve the risk of being stably integrated into the genome of the transfected cell, thus eliminating the concern that the introduced genetic material will disrupt the normal functioning of an essential gene, or cause a mutation that results in deleterious or oncogenic effects, and extraneous promoter sequences are not required for effective translation of the encoded protein, again avoiding possible deleterious side effects. In addition, it is not necessary for mRNA to enter the nucleus to perform its function, while DNA must overcome this major barrier.

Circular RNA is useful in the design and production of stable forms of RNA. The circularization of an RNA molecule provides an advantage to the study of RNA structure and function, especially in the case of molecules that are prone to folding in an inactive conformation (Wang and Ruffner, 1998). Circular RNA can also be particularly interesting and useful for in vivo applications, especially in the research area of RNA-based control of gene expression and therapeutics, including protein replacement therapy and vaccination.

Prior to this invention, there were three main techniques for making circularized RNA in vitro: the splint-mediated method, the permuted intron-exon method, and the RNA ligase-mediated method. However, the existing methodologies are limited by the size of RNA that can be circularized, thus limiting their therapeutic application.

SUMMARY

In one aspect, provided herein are precursor RNA polynucleotides comprising: a. a 5' enhanced intron element, b. a 5' enhanced exon element, c. a core functional element, d. a 3' enhanced exon element, and e. a 3' enhanced intron element, wherein the core functional element comprises: i. a translation initiation element (TIE), ii. a coding element encoding a CAR that specifically binds to BCMA, and iii. optionally, a stop codon or a stop cassette. In some embodiments, the CAR comprises an amino acid sequence selected from the group consisting of SEQ ID NO: 3690-3695.

In some embodiments, the translation initiation element (TIE) comprises an UTR or a fragment thereof, an aptamer complex or a fragment thereof, or a combination thereof. In some embodiments, the UTR or fragment thereof comprises a viral internal ribosome entry site (IRES) or a eukaryotic IRES. In some embodiments, the 5' enhanced intron element comprises a group I intron or fragment thereof. In some embodiments, the 3' enhanced intron element comprises a group I intron or fragment thereof. In some embodiments, the 5' enhanced intron element further comprises a first or a first and a second nucleotide of a 3' group I intron splice site dinucleotide. In some embodiments, the 3' enhanced intron element further comprises a second nucleotide of a 3' group I intron splice site dinucleotide.

In one aspect, provided herein is a circular RNA polynucleotide comprising a coding element encoding a chimeric antigen receptor (CAR), wherein the CAR comprises an antigen binding molecule that specifically binds to BCMA and comprises an amino acid sequence selected from the group consisting of SEQ ID NO: 3690-3695. In some embodiments, a circular RNA polynucleotide disclosed herein, further comprises a polynucleotide sequence encoding a CAR comprising an antigen binding molecule that specifically binds to CD19. In some embodiments, the coding element is codon optimized. In some embodiments, the CAR comprises an amino acid sequence of SEQ ID NO: 3690. In some embodiments, the circular RNA is formed from a precursor RNA polynucleotide that was transcribed from a vector or DNA comprising a PCR product, a linearized plasmid, non-linearized plasmid, linearized minicircle, a non-linearized minicircle, viral vector, cosmid, ceDNA, or an artificial chromosome. In some embodiments, a circular RNA polynucleotide disclosed herein, further comprises a translation initiation element (TIE), wherein the TIE comprises internal ribosome entry site (IRES). In some embodiments, the IRES is derived from Enterovirus, Bopivirus, Mischivirus, Gallivirus, Oscivirus, Cardiovirus, Kobuvirus, Rabovirus, Salivirus, Caliciviridae, Parechovirus, Hunnivirus, Tottorivirus, Passerivirus, Cosavirus, Sicinivirus, Shanbavirus, Allexivirus, or Megrivirus. In some embodiments, a circular RNA polynucleotide disclosed herein, further comprises an internal spacer sequence. In some embodiments, a circular RNA polynucleotide disclosed herein, further comprises 1 to 100 natural nucleotides derived from a natural exon.

In one aspect, provided herein is a pharmaceutical composition comprising: a. a circular RNA polynucleotide comprising a coding element encoding a chimeric antigen receptor (CAR), wherein the CAR comprises an antigen binding molecule that specifically binds to BCMA; and b. a nanoparticle, and optionally, a targeting moiety operably connected to the nanoparticle.

In some embodiments, the nanoparticle is a lipid nanoparticle, a core-shell particle, or a biodegradable nanoparticle. In some embodiments, the nanoparticle comprises one or more cationic lipids, ionizable lipids, or poly β-amino esters. In some embodiments, the nanoparticle comprises one or more non-cationic lipids. In some embodiments, the nanoparticle comprises one or more PEG-modified lipids, polyglutamic acid lipids, or hyaluronic acid lipids. In some embodiments, the nanoparticle comprises cholesterol. In some embodiments, the nanoparticle comprises arachidonic acid, leukotriene, or oleic acid.

In one aspect, provided herein is an improved expression construct encoding a chimeric antigen receptor (CAR), wherein the CAR comprises an antigen-binding molecule that specifically binds to BCMA, the improvement comprising a circular RNA polynucleotide expression sequence.

In one aspect, provided herein is a method of treating a subject in need thereof comprising administering a therapeutically effective amount of a composition comprising the circular RNA disclosed herein, a nanoparticle, and optionally, a targeting moiety operably connected to the nanoparticle.

In some embodiments, the subject has a cancer selected from the group consisting of: acute myeloid leukemia (AML); alveolar rhabdomyosarcoma; B cell malignancies; bladder cancer (e.g., bladder carcinoma); bone cancer; brain cancer (e.g., medulloblastoma and glioblastoma multiforme); breast cancer; cancer of the anus, anal canal, or anorectum; cancer of the eye; cancer of the intrahepatic bile duct; cancer of the joints; cancer of the neck; gallbladder cancer; cancer of the pleura; cancer of the nose, nasal cavity, or middle ear; cancer of the oral cavity; cancer of the vulva; chronic lymphocytic leukemia; chronic myeloid cancer; colon cancer; esophageal cancer, cervical cancer; fibrosarcoma; gastrointestinal carcinoid tumor; head and neck cancer (e.g., head and neck squamous cell carcinoma); Hodgkin lymphoma; hypopharynx cancer; kidney cancer; larynx cancer; leukemia; liquid tumors; lipoma; liver cancer; lung cancer (e.g., non-small cell lung carcinoma, lung adenocarcinoma, and small cell lung carcinoma); lymphoma; mesothelioma; mastocytoma; melanoma; multiple myeloma; nasopharynx cancer; non-Hodgkin lymphoma; B-chronic lymphocytic leukemia; hairy cell leukemia; Burkitt's lymphoma; ovarian cancer; pancreatic cancer; cancer of the peritoneum; cancer of the omentum; mesentery cancer; pharynx cancer; prostate cancer; rectal cancer; renal cancer; skin cancer; small intestine cancer; soft tissue cancer; solid tumors; synovial sarcoma; gastric cancer; teratoma; testicular cancer; thyroid cancer; and ureter cancer.

In one aspect, provided herein is a eukaryotic cell comprising a circular RNA polynucleotide disclosed herein. In some embodiments, the eukaryotic cell is an immune cell. In some embodiments, the eukaryotic cell is a T cell, dendritic cell, macrophage, B cell, neutrophil or basophil.

In one aspect, provided herein are circular RNA polynucleotide expression vectors encoding a chimeric antigen receptor (CAR), wherein the CAR comprises an antigen-binding molecule that specifically binds to BCMA.

In some embodiments, a CAR disclosed herein comprises an amino acid sequence selected from the group consisting of SEQ ID NO: 3690-3695.

In some embodiments, a circular RNA polynucleotide expression vector disclosed herein further comprises a polynucleotide sequence encoding a CAR comprising an antigen binding molecule that specifically binds to CD19.

In some embodiments, the protein coding or non-coding sequence is codon optimized.

In some embodiments, a circular RNA polynucleotide expression vector disclosed herein is optimized to lack at least one microRNA binding site present in an equivalent pre-optimized polynucleotide.

In some embodiments, a circular RNA polynucleotide expression vector disclosed herein is optimized to lack at least one RNA-editing susceptible site present in an equivalent pre-optimized polynucleotide.

In some embodiments, a circular RNA polynucleotide expression vector disclosed herein has an in vivo duration of therapeutic effect in humans of at least 20 hours.

In some embodiments, a circular RNA polynucleotide expression vector disclosed herein has a functional half-life of at least 6 hours.

In some embodiments, a circular RNA polynucleotide expression vector disclosed herein has a duration of therapeutic effect in a human cell greater than or equal to that of an equivalent linear RNA polynucleotide comprising the same expression sequence.

In some embodiments, a circular RNA polynucleotide expression vector disclosed herein has an in vivo duration of therapeutic effect in human greater than that of an equivalent linear RNA polynucleotide having the same expression sequence.

In some embodiments, the precursor RNA polynucleotide is transcribed from a vector or DNA comprising a PCR product, a linearized plasmid, non-linearized plasmid, linearized minicircle, a non-linearized minicircle, viral vector, cosmid, ceDNA, or an artificial chromosome.

In some embodiments, a pharmaceutical composition comprises a circular RNA polynucleotide expression vector disclosed herein, a nanoparticle, and optionally, a targeting moiety operably connected to the nanoparticle.

In some embodiments, the nanoparticle is a lipid nanoparticle, a core-shell nanoparticle, a biodegradable nanoparticle, a biodegradable lipid nanoparticle, a polymer nanoparticle, a polyplex or a biodegradable polymer nanoparticle.

In some embodiments, a pharmaceutical composition disclosed herein comprises a targeting moiety, wherein the targeting moiety mediates receptor-mediated endocytosis, endosome fusion, or direct fusion into selected cells of a selected cell population or tissue in the absence of cell isolation or purification.

In some embodiments, a pharmaceutical composition disclosed herein comprises a targeting moiety operably connected to the nanoparticle.

In some embodiments, the targeting moiety is a small molecule, scFv, nanobody, peptide, cyclic peptide, di or tri cyclic peptide, minibody, polynucleotide aptamer, engineered scaffold protein, heavy chain variable region, light chain variable region, or a fragment thereof.

In some embodiments, a pharmaceutical composition disclosed herein, wherein less than 1%, by weight, of the polynucleotides in the composition are double stranded RNA, DNA splints, DNA template, or triphosphorylated RNA.

In some embodiments, a pharmaceutical composition disclosed herein, wherein less than 1%, by weight, of the polynucleotides and proteins in the pharmaceutical composition are double stranded RNA, DNA splints, DNA template, triphosphorylated RNA, phosphatase proteins, protein ligases, RNA polymerases, and capping enzymes.

In one aspect, provided herein is a pharmaceutical composition comprising a circular RNA polynucleotide disclosed herein and a pharmaceutical salt, buffer, diluent or combination thereof.

In one aspect, provided herein is an improved expression construct encoding a chimeric antigen receptor (CAR), wherein the CAR comprises an antigen-binding molecule that specifically binds to BCMA, the improvement comprising a circular RNA polynucleotide expression vector.

In one aspect, provided herein is a circular RNA polynucleotide expression vector encoding a chimeric antigen receptor (CAR), wherein the CAR comprises means for specifically binding to BCMA.

In one aspect, provided herein is a recombinant cell, expressing the CAR encoded by the circular RNA polynucleotide expression vector disclosed herein.

In some embodiments, the cell is an immune cell.

In some embodiments, the immune cell is a T cell, an NK cell, or a macrophage.

In one aspect, provided herein are precursor RNA polynucleotides comprising, in the following order: a. a 5' enhanced intron element, b. a 5' enhanced exon element, c. a core functional element, d. a 3' enhanced exon element, and e. a 3' enhanced intron element, wherein the core functional element comprises, in the following order: i. a translation initiation element (TIE), ii. a coding element encoding a CAR that specifically binds to BCMA, and iii. optionally, a stop codon or a stop cassette.

In one aspect, provided herein are precursor RNA polynucleotides comprising, in the following order: a. a 5' enhanced intron element, b. a 5' enhanced exon element, c. a core functional element, d. a 3' enhanced exon element, and e. a 3' enhanced intron element wherein the core functional element comprises, in the following order: i. a coding region encoding a CAR that specifically binds to BCMA, ii. optionally, a stop codon or a stop cassette, and iii. a translation initiation element (TIE).

In some embodiments, the core functional element further comprises a noncoding element.

In some embodiments, the TIE comprises an untranslated region (UTR) or a fragment thereof, an aptamer complex or a fragment thereof, or a combination thereof.

In some embodiments, the UTR or fragment thereof is derived from a viral or eukaryotic messenger RNA. In some embodiments, the UTR or fragment thereof comprises a viral internal ribosome entry site (IRES) or eukaryotic IRES. In some embodiments, the IRES comprises a sequence selected from Table_A or a fragment thereof. In some embodiments, the IRES comprises one or more modified nucleotides compared to the wild-type viral IRES or eukaryotic IRES.

In some embodiments, the aptamer complex or a fragment thereof comprises a natural or synthetic aptamer sequence. In some embodiments, the aptamer complex or a fragment thereof comprises a sequence selected from any of the ASCII tables. In some embodiments, the aptamer complex or a fragment thereof comprises more than one aptamer.

In some embodiments, the TIE comprises an UTR and an aptamer complex. In some embodiments, the UTR is located upstream to the aptamer complex. In some embodiments, the TIE further comprises an accessory element. In some embodiments, the accessory element comprises a miRNA binding site or a fragment thereof, a restriction site or a fragment thereof, an RNA editing motif or a fragment thereof, a zip code element or a fragment thereof, an RNA trafficking element or a fragment thereof, or a combination thereof. In some embodiments, the accessory element comprises a binding domain to an IRES transacting factor (ITAF). In some embodiments, the binding domain comprises a polyA region, a polyC region, a poly AC region, a polyprimidine tract, or a combination or variant thereof. In some embodiments, the ITAF comprises a poly(rC)-binding protein 1 (PCBP1), PCBP2, PCBP3, PCBP4, poly(A)-binding protein 1 (PABP1), polyprimidine-tract binding protein (PTB), Argonaute protein family member, HNRNPK (heterogeneous nuclear ribonucleoprotein K protein), or La protein, or a fragment or combination thereof.

In some embodiments, the noncoding element comprises more than one noncoding element. In some embodiments, the noncoding element comprises 50 to 15,000 nucleotides in length. In some embodiments, the noncoding element sequence comprises or consists of a sequence selected from any of the ASCII tables.

In some embodiments, the core functional element comprises a termination sequence. In some embodiments, the termination sequence is located at the 5' end of the 3' enhanced exon element. In some embodiments, the termination sequence is a stop codon. In some embodiments, termination sequence is a stop cassette. In some embodiments, the stop cassette comprises one or more stop codons in one or more frames. In some embodiments, each frame comprises a stop codon. In some embodiments, each frame comprises two or more stop codons.

In some embodiments, the 5' enhanced intron element comprises a 3' intron fragment. In some embodiments, the 3' intron fragment further comprises a first or a first and a second nucleotides of a 3' group I intron splice site dinucleotide. In some embodiments, the 3' intron fragment is located at the 3' end of the 5' enhanced intron element. In some embodiments, the group I intron comprises is derived from a bacterial phage, viral vector, organelle genome, nuclear rDNA gene. In some embodiments, the nuclear rDNA gene comprises a nuclear rDNA gene derived from a fungi, plant, or algae, or a fragment thereof.

In some embodiments, the 5' enhanced intron element comprises a leading untranslated sequence located at the 5' end. In some embodiments, the leading untranslated sequence comprises a spacer. In some embodiments, the leading untranslated sequence comprises the last nucleotide of a transcription start site. In some embodiments, the leading untranslated sequence comprises 1 to 100 additional nucleotides.

In some embodiments, the 5' enhanced intron element comprises a 5' affinity sequence. In some embodiments, the 5' affinity sequence comprises a polyA, polyAC, or polypyrimidine sequence. In some embodiments, the 5' affinity sequence comprises 10 to 100 nucleotides. In some embodiments, the 5' enhanced intron element comprises a 5' external spacer sequence. In some embodiments, the 5' external spacer sequence is located between the 5' affinity sequence and the 3' intron fragment. In some embodiments, the 5' external spacer sequence has a length of about 6 to 60 nucleotides. In some embodiments, the 5' external spacer sequence comprises or consists of a sequence selected from any of the ASCII tables.

In some embodiments, the 5' enhanced intron element comprises, in the following order: a. a leading untranslated sequence; b. a 5' affinity sequence; c. a 5' external spacer sequence; and d. a 3' intron fragment including the first nucleotide of a 3' Group I intron splice site; wherein the leading untranslated sequence comprises the last nucleotide of a transcription start site and 1 to 100 nucleotides.

In some embodiments, the 5' enhanced intron element comprises, in the following order: a. a leading untranslated sequence; b. a 5' external spacer sequence; c. a 5' affinity sequence; and d. a 3' intron fragment including the first nucleotide of a 3' group I splice site; wherein the leading untranslated sequence comprises the last nucleotide of a transcription start site and 1 to 100 nucleotide.

In some embodiments, the 5' enhanced intron element comprises, in the following order: a. a leading untranslated sequence; b. a 5' affinity sequence; c. a 5' external spacer sequence; and d. a 3' intron fragment including the first and second nucleotides of a 3' Group I intron splice site; wherein the leading untranslated sequence comprises the last nucleotide of a transcription start site and 1 to 100 nucleotides; and wherein the 5' enhanced exon element comprises a 3' exon fragment lacking the second nucleotide of a 3' group I splice site dinucleotide.

In some embodiments, the 5' enhanced intron element comprises, in the following order: a. a leading untranslated sequence; b. a 5' external spacer sequence; c. a 5' affinity sequence; and d. a 3' intron fragment including the first and second nucleotides of a 3' Group I splice site; wherein the leading untranslated sequence comprises the last nucleotide of a transcription start site and 1 to 100 nucleotide; and wherein the 5' enhanced exon element comprises a 3' exon fragment lacking the second nucleotide of a 3' group I splice site dinucleotide.

In some embodiments, the 5' enhanced exon element comprises a 3' exon fragment. In some embodiments, the 3' exon fragment further comprises the second nucleotide of a 3' group I intron splice site dinucleotide. In some embodiments, the 3' exon fragment comprises 1 to 100 natural nucleotides derived from a natural exon. In some embodiments, the natural exon derived from a Group I intron containing gene or a fragment thereof. In some embodiments, the natural exon derived from an anabaena bacterium, T4 phage virus, twort bacteriophage, tetrahymena, or azoarcus bacterium.

In some embodiments, the 5' enhanced exon element comprises a 5' internal spacer sequence located downstream from the 3' exon fragment. In some embodiments, the 5' internal spacer sequence is about 6 to 60 nucleotides in length. In some embodiments, the 5' internal spacer sequence comprises or consists of a sequence selected from any of the ASCII tables.

In some embodiments, the 5' enhanced exon element comprises in the following order: a. a 3' exon fragment including the second nucleotide of a 3' group I intron splice site dinucleotide; and b. a 5' internal spacer sequence, wherein the 3' exon fragment comprises 1 to 100 natural nucleotides derived from a natural exon.

In some embodiments, the 5' enhanced exon element comprises in the following order: a. a 3' exon fragment; and b. a 5' internal spacer sequence, wherein the 3' exon fragment comprises 1 to 100 natural nucleotides derived from a natural exon; and wherein the 5' enhanced intron element comprises a 3' intron fragment comprising the first and second nucleotides of a 3' group I splice site dinucleotide.

In some embodiments, the 3' enhanced exon element comprises a 5' exon fragment. In some embodiments, the 5' exon fragment comprises the first nucleotide of a 5' group I intron fragment. In some embodiments, the 5' exon fragment further comprises 1 to 100 nucleotides derived from a natural exon. In some embodiments, the natural exon is derived from a Group I intron containing gene or a fragment thereof.

In some embodiments, the 3' enhanced exon element comprises a 3' internal spacer sequence. In some embodiments, the 3' internal spacer sequence is located between the termination sequence and the 5' exon fragment. In some embodiments, the 3' internal spacer is about 6 to 60 nucleotides in length. In some embodiments, the 3' internal spacer comprises or consists of a sequence selected from any of the ASCII tables.

In some embodiments, the 3' enhanced exon element comprises: a. a 3' internal spacer sequence; and b. a 5' exon fragment including the first nucleotide of a 5' group I intron splice site dinucleotide, wherein the 5' exon fragment comprises 1 to 100 nucleotides derived from a natural exon.

In some embodiments, the 3' enhanced exon element comprises: a. a 3' internal spacer sequence; and b. a 5' exon fragment, wherein the 5' exon fragment comprises 1 to 100 nucleotides derived from a natural exon; wherein the 3' enhanced intron element comprises a 5' intron fragment comprising the first and second nucleotide of a 5' group I intron splice site dinucleotide.

In some embodiments, the 3' enhanced intron element comprises a 5' intron fragment. In some embodiments, the 5' intron fragment comprises a second nucleotide of a 5' group I intron splice site dinucleotide.

In some embodiments, the 3' enhanced intron element comprises a trailing untranslated sequence located at the 3' end of the 5' intron. In some embodiments, the trailing untranslated sequence comprises 3 to 12 nucleotides.

In some embodiments, the 3' enhanced intron fragment comprises a 3' external spacer sequence. In some embodiments, the 3' external spacer sequence is located between the 5' intron fragment and trailing untranslated sequence. In some embodiments, the 3' external spacer sequence has a length of 6 to 60 nucleotides in length. In some embodiments, the 3' external spacer sequence comprises or consists of a sequence selected from any of the ASCII tables.

In some embodiments, the 3' enhanced intron element comprises a 3' affinity sequence. In some embodiments, the 3' affinity sequence is located between the 3' external spacer sequence and the trailing untranslated sequence. In some embodiments, the 3' affinity sequence comprises a polyA, poly AC, or polypyrimidine sequence. In some embodiments, the affinity sequence comprises 10 to 100 nucleotides.

In some embodiments, the 5' enhanced intron element further comprises a 5' external duplex sequence; wherein the 3' enhanced intron element further comprises a 3' external duplex sequence. In some embodiments, the 5' external duplex sequence and 3' external duplex sequence are fully or partially complementary to each other. In some embodiments, the 5' external duplex sequence comprises fully synthetic or partially synthetic nucleotides. In some embodiments, the 3' external duplex sequence comprises fully synthetic or partially synthetic nucleotides. In some embodiments, the 3' external duplex sequence is about 6 to about 50 nucleotides. In some embodiments, the 5' external duplex sequence is about 6 to about 50 nucleotides. In some embodiments, the 3' external duplex sequence comprises or consists of a sequence selected from any of the ASCII tables. In some embodiments, the 5' external duplex sequence comprises or consists of a sequence selected from any of the ASCII tables.

In some embodiments, the 5' enhanced exon element further comprises a 5' internal duplex sequence; wherein the 3' enhanced exon element further comprises a 3' internal duplex sequence. In some embodiments, the 5' internal duplex sequence and 3' internal duplex sequence are fully or partially complementary to each other. In some embodiments, the 5' internal duplex sequence comprises fully synthetic or partially synthetic nucleotides. In some embodiments, the 3' internal duplex sequence comprises fully synthetic or partially synthetic nucleotides. In some embodiments, the 3' internal duplex sequence is about 6 to about 19 nucleotides. In some embodiments, the 5' internal duplex sequence is about 6 to about 19 nucleotides. In some embodiments, the 3' internal duplex sequence comprises or consists of a sequence selected from any of the ASCII tables. In some embodiments, the 5' internal duplex sequence comprises or consists of a sequence selected from any of the ASCII tables.

In some embodiments, the 3' enhanced intron fragment comprises in the following order: a. a 5' intron fragment including the second nucleotide of a 5' group I intron splice site dinucleotide; b. a 3' external spacer sequence; and c. a 3' affinity sequence.

In some embodiments, the 3' enhanced intron fragment comprises in the following order: a. a 5' intron fragment including the first and second nucleotide of a 5' group I intron splice site dinucleotide; b. a 3' external spacer sequence; and c. a 3' affinity sequence, wherein the 3' enhanced exon element comprises a 5' exon fragment lacking the first nucleotide of a 5' group I intron splice site dinucleotide.

In some embodiments, a provided precursor RNA polynucleotide comprises in the following order: a. a leading untranslated sequence; b. a 5' affinity sequence; c. 5' external duplex sequence; d. 5' spacer sequence; e. 3' intron fragment; f. 3' exon fragment; g. 5' internal duplex sequence; h. 5' internal spacer sequence; i. a translation initiation element; j. a coding element; k. a termination sequence; l. a 3' internal spacer sequence; m. a 3' internal duplex sequence; n. a 5' exon fragment; o. a 5' intron fragment; p. a 3' external duplex sequence; q. a 3' affinity sequence; and r. a trailing untranslated sequence.

In some embodiments, a provided precursor RNA polynucleotide comprises in the following order: a. a leading untranslated sequence; b. a 5' affinity sequence; c. a 5' external spacer sequence; d. a 3' intron fragment; e. a 3' exon fragment; f. a 5' internal duplex sequence; g. a 5' internal spacer sequence; h. a noncoding element; i. a 3' internal spacer sequence; j. a 3' internal duplex sequence; k. a 5' exon fragment; l. a 5' intron fragment; m. a 3' external spacer sequence; n. a 3' affinity sequence; and o. a trailing untranslated sequence.

In some embodiments, a provided precursor RNA polynucleotide comprises in the following order: a. a leading untranslated sequence; b. a 5' affinity sequence; c. a 5' external spacer sequence; d. a 3' intron fragment; e. a 3' exon fragment; f. a 5' internal duplex sequence; g. a 5' internal spacer sequence; h. a translation initiation element; i. a coding element encoding a CAR that specifically binds to BCMA; j. a termination sequence; k. a 3' internal spacer sequence; l. a 3' internal duplex sequence; m. a 5' exon fragment; n. a 5' intron fragment; o. a 3' external spacer sequence; and p. a 3' affinity sequence.

In some embodiments, a provided precursor RNA polynucleotide comprises in the following order: a. a leading untranslated sequence; b. a 5' affinity sequence; c. a 5' external spacer sequence; d. a 3' intron fragment; e. a 3' exon fragment; f. a 5' internal spacer sequence; g. a translation initiation element; h. a coding element encoding a CAR that specifically binds to BCMA; i. a termination sequence; j. a 3' internal spacer sequence; k. a 5' exon fragment; l. a 5' intron fragment; m. a 3' external spacer sequence; and n. a 3' affinity sequence.

In some embodiments, a provided precursor RNA polynucleotide comprises in the following order: a. a leading untranslated sequence; b. a 5' affinity sequence; c. a 5' external spacer sequence; d. a 3' intron fragment; e. a 3' exon fragment; f. a 5' internal spacer sequence; g. a noncoding element; h. a 3' internal spacer sequence; i. a 5' exon fragment; j. a 5' intron fragment; k. a 3' external spacer sequence; l. a 3' affinity sequence; and m. a trailing untranslated sequence.

In some embodiments, a provided precursor RNA polynucleotide comprises in the following order: a. a leading untranslated sequence; b. a 5' affinity sequence; c. 5' external duplex sequence; d. 5' spacer sequence; e. 3' intron fragment; f. 3' exon fragment; g. 5' internal duplex sequence; h. 5' internal spacer sequence; i. a termination sequence; j. a coding element encoding a CAR that specifically binds to BCMA; k. a translation initiation element; l. a 3' internal spacer sequence; m. a 3' internal duplex sequence; n. a 5' exon fragment; o. a 5' intron fragment; p. a 3' external duplex sequence; q. a 3' affinity sequence; and r. a trailing untranslated sequence.

In some embodiments, the coding element comprises two or more protein coding regions. In some embodiments, the precursor RNA polynucleotide comprises a polynucleotide sequence encoding a proteolytic cleavage site or a ribosomal stuttering element between the first and second expression sequence. In some embodiments, the ribosomal stuttering element is a self-cleaving spacer. In some embodiments, the precursor RNA polynucleotide comprises a polynucleotide sequence encoding 2A ribosomal stuttering peptide.

In some embodiments, the core functional element comprises two or more internal ribosome entry sites (IRESs). In some embodiments, the core functional element comprises a TIE, a coding element, a termination sequence, optionally a spacer, a TIE, a coding element, and a termination sequence, wherein the TIE comprises an IRES.

Also provided herein are circular RNA polynucleotides produced from the precursor RNA polynucleotides provided herein. In some embodiments, the precursor RNA polynucleotide is transcribed from a vector or DNA comprising a PCR product, a linearized plasmid, non-linearized plasmid, linearized minicircle, a non-linearized minicircle, viral vector, cosmid, ceDNA, or an artificial chromosome. In some embodiments, the circular RNA polynucleotide consists of natural nucleotides. In some embodiments, the protein coding or non-coding sequence is codon optimized. In some embodiments, the circular RNA polynucleotide is from about 0.1 to about 15 kilobases in length. In some embodiments, the circular RNA polynucleotide is optimized to lack at least one microRNA binding site present in an equivalent pre-optimized polynucleotide. In some embodiments, the circular RNA polynucleotide is optimized to lack at least one RNA-editing susceptible site present in an equivalent pre-optimized polynucleotide. In some embodiments, the circular RNA polynucleotide has an in vivo duration of therapeutic effect in humans of at least 20 hours. In some embodiments, the circular RNA polynucleotide has a functional half-life of at least 6 hours. In some embodiments, the circular RNA polynucleotide has a duration of therapeutic effect in a human cell greater than or equal to that of an equivalent linear RNA polynucleotide comprising the same expression sequence. In some embodiments, the circular RNA polynucleotide has an in vivo duration of therapeutic effect in human greater than that of an equivalent linear RNA polynucleotide having the same expression sequence.

Also provided herein is a method of making a translation initiation element (TIE) comprising: a. obtaining a viral untranslated region (UTR); b. determining the functional unit of the UTR capable of binding to an initiation factor and/or initiating translation by progressively deleting sequence; c. removing non-functional units of the UTR; and optionally, modifying the ends of the UTR. In some embodiments, the modification of the ends of the UTR is about 1 percent to 75% of the viral UTR. In some embodiments, the functional unit of UTR is determined by deletion scanning from the 5' and 3' ends of the UTR or mutational scanning across the length of the UTR to identify important regions.

Also provided herein is a pharmaceutical composition comprising a circular RNA polynucleotide provided herein, a nanoparticle, and optionally, a targeting moiety operably connected to the nanoparticle. In some embodiments, the nanoparticle is a lipid nanoparticle, a core-shell nanoparticle, a biodegradable nanoparticle, a biodegradable lipid nanoparticle, a polymer nanoparticle, a polyplex or a biodegradable polymer nanoparticle. In some embodiments, the pharmaceutical composition comprises a targeting moiety, wherein the targeting moiety mediates receptor-mediated endocytosis, endosome fusion, or direct fusion into selected cells of a selected cell population or tissue in the absence of cell isolation or purification. In some embodiments, the pharmaceutical composition comprises a targeting moiety operably connected to the nanoparticle. In some embodiments, the targeting moiety is a small molecule, scFv, nanobody, peptide, cyclic peptide, di or tri cyclic peptide, minibody, polynucleotide aptamer, engineered scaffold protein, heavy chain variable region, light chain variable region, or a fragment thereof. In some embodiments, less than 1%, by weight, of the polynucleotides in the composition are double stranded RNA, DNA splints, DNA template, or triphosphorylated RNA. In some embodiments, less than 1%, by weight, of the polynucleotides and proteins in the pharmaceutical composition are double stranded RNA, DNA splints, DNA template, triphosphorylated RNA, phosphatase proteins, protein ligases, RNA polymerases, and capping enzymes.

Also provided herein is a pharmaceutical composition comprising a circular RNA polynucleotide provided herein and a liposome, dendrimer, carbohydrate carrier, glycan nanomaterial, fusome, exosome, or a combination thereof.

Also provided herein is a pharmaceutical composition a circular RNA polynucleotide provided herein and a pharmaceutical salt, buffer, diluent or combination thereof.

Also provided herein is a method of treating a subject in need thereof comprising administering a therapeutically effective amount of a composition comprising the circular RNA polynucleotide provided herein, a nanoparticle, and optionally, a targeting moiety operably connected to the nanoparticle. In some embodiments, the targeting moiety is a small molecule, scFv, nanobody, peptide, cyclic peptide, di or tri cyclic peptide, minibody, heavy chain variable region, engineered scaffold protein, light chain variable region or fragment thereof. In some embodiments, the nanoparticle is a lipid nanoparticle, a core-shell nanoparticle, or a biodegradable nanoparticle. In some embodiments, the nanoparticle comprises one or more cationic lipids, ionizable lipids, or poly β-amino esters. In some embodiments, the nanoparticle comprises one or more non-cationic lipids. In some embodiments, the nanoparticle comprises one or more PEG-modified lipids, polyglutamic acid lipids, or hyaluronic acid lipids. In some embodiments, the nanoparticle comprises cholesterol. In some embodiments, the nanoparticle comprises arachidonic acid, leukotriene, or oleic acid. In some embodiments, the composition comprises a targeting moiety, wherein the targeting moiety mediates receptor-mediated endocytosis selectively into cells of a selected cell population in the absence of cell selection or purification. In some embodiments, the nanoparticle comprises more than one circular RNA polynucleotide. In some embodiments, the subject has a cancer selected from the group consisting of: acute myeloid leukemia (AML); alveolar rhabdomyosarcoma; B cell malignancies; bladder cancer (e.g., bladder carcinoma); bone cancer; brain cancer (e.g., medulloblastoma and glioblastoma multiforme); breast cancer; cancer of the anus, anal canal, or anorectum; cancer of the eye; cancer of the intrahepatic bile duct; cancer of the joints; cancer of the neck; gallbladder cancer; cancer of the pleura; cancer of the nose, nasal cavity, or middle ear; cancer of the oral cavity; cancer of the vulva; chronic lymphocytic leukemia; chronic myeloid cancer; colon cancer; esophageal cancer; cervical cancer; fibrosarcoma; gastrointestinal carcinoid tumor; head and neck cancer (e.g., head and neck squamous cell carcinoma); Hodgkin lymphoma; hypopharynx cancer; kidney cancer; larynx cancer; leukemia; liquid tumors; lipoma; liver cancer; lung cancer (e.g., non-small cell lung carcinoma, lung adenocarcinoma, and small cell lung carcinoma); lymphoma; mesothelioma; mastocytoma; melanoma; multiple myeloma; nasopharynx cancer; non-Hodgkin lymphoma; B-chronic lymphocytic leukemia; hairy cell leukemia; Burkitt's lymphoma; ovarian cancer; pancreatic cancer; cancer of the peritoneum; cancer of the omentum; mesentery cancer; pharynx cancer; prostate cancer; rectal cancer; renal cancer; skin cancer; small intestine cancer; soft tissue cancer; solid tumors; synovial sarcoma; gastric cancer; teratoma; testicular cancer; thyroid cancer; and ureter cancer. In some embodiments, the subject has an autoimmune disorder selected from scleroderma, Grave's disease, Crohn's disease, Sjogren's disease, multiple sclerosis, Hashimoto's disease, psoriasis, myasthenia gravis, autoimmune polyendocrinopathy syndromes, Type I diabetes mellitus (TIDM), autoimmune gastritis, autoimmune uveoretinitis, polymyositis, colitis, thyroiditis, and the generalized autoimmune diseases typified by human Lupus.

Also provided herein is a eukaryotic cell comprising a circular RNA polynucleotide or pharmaceutical composition provided herein. In some embodiments, the eukaryotic cell is a human cell. In some embodiments, the eukaryotic cell is an immune cell. In some embodiments, the eukaryotic cell is a T cell, dendritic cell, macrophage, B cell, neutrophil, or basophil.

Also provided herein is a prokaryotic cell comprising a circular RNA polynucleotide provided herein.

In another aspect, provided herein are methods of purifying circular RNA, comprising hybridizing an oligonucleotide conjugated to a solid surface with an affinity sequence.

In some embodiments, one or more copies of the affinity sequence is present in a precursor RNA. In some embodiments, the precursor RNA is the precursor described herein. In some embodiments, the circular RNA is the circular RNA described herein. In some embodiments, the affinity sequence is removed during formation of the circular RNA. In some embodiments, the method comprises separating the circular RNA from the precursor RNA.

In some embodiments, the affinity sequence comprises a polyA sequence. In some embodiments, the oligonucleotide that hybridizes to the affinity sequence is a deoxythymidine oligonucleotide. In some embodiments, the affinity sequence comprises a dedicated binding site (DBS). In some embodiments, the DBS comprises the nucleotide sequence of: of TATAATTCTACCCTATTGAGGCATTGACTA (SEQ ID NO: 3667). In some embodiments, the oligonucleotide that hybridizes to the affinity sequence comprises a sequence complementary to the DBS.

In another aspect, provided herein are methods of purifying circular RNA comprising: a. contacting a composition comprising linear RNA and circular RNA with a binding agent that preferentially binds to the linear RNA over the circular RNA; and b. separating RNA bound to the binding agent from RNA that is not bound to the binding agent.

In some embodiments, the binding agent is conjugated to a solid support. In some embodiments, the solid support comprises agarose, an agarose-derived resin, cellulose, a cellulose fiber, a magnetic bead, a high throughput microtiter plate, a non-agarose resin, a glass surface, a polymer surface, or a combination thereof. In some embodiments, the solid support comprises agarose or cellulose.

In some embodiments, the binding agent comprises an oligonucleotide that is complementary to a sequence present in the linear RNA and absent from the circular RNA. In some embodiments, the binding agent comprises an oligonucleotide that is 100% complementary to a sequence present in the linear RNA and absent from the circular RNA. In some embodiments, the sequence present in the linear RNA and absent from the circular RNA is an affinity sequence. In some embodiments, the sequence present in the linear RNA and absent from the circular RNA comprises a polyA sequence. In some embodiments, the binding agent comprises an oligonucleotide comprising a poly-deoxythymidine sequence. In some embodiments, the sequence present in the linear RNA and absent from the circular RNA comprises a DBS sequence. In some embodiments, the DBS sequence comprises the nucleotide sequence of: of TATAATTCTACCCTATTGAGGCATTGACTA (SEQ ID NO: 3667). In some embodiments, the sequence present in the linear RNA and absent from the circular RNA is 10-150 nucleotides in length. In some embodiments, the sequence present in the linear RNA and absent from the circular RNA is 10-70 nucleotides in length. In some embodiments, the sequence present in the linear RNA and absent from the circular RNA is 20-30 nucleotides in length. In some embodiments, the sequence present in the linear RNA and absent from the circular RNA is present at two locations in the linear RNA. In some embodiments, the sequence present in the linear RNA and absent from the circular RNA is encoded into the linear RNA during transcription of the linear RNA. In some embodiments, the sequence present in the linear RNA and absent from the circular RNA is enzymatically added to the linear RNA. In some embodiments, the linear RNA does not comprise a methylguanylate cap. In some embodiments, the linear RNA comprises a precursor RNA or a fragment thereof.

In some embodiments, the precursor RNA is the precursor RNA described herein or a fragment thereof. In some embodiments, the precursor RNA is produced using in vitro transcription (IVT). In some embodiments, the fragment comprises an intron. In some embodiments, the linear RNA comprises a prematurely terminated RNA or RNA formed by abortive transcription.

In some embodiments, the circular RNA comprises the circular RNA described herein. In some embodiments, the circular RNA is produced using a method comprising splicing the precursor RNA. In some embodiments, the sequence present in the linear RNA and absent from the circular RNA is excised during the splicing. In some embodiments, the circular RNA is less than 6 kilobases in size.

In some embodiments, the separating comprises removing the unbound RNA from the solid support. In some embodiments, the removing comprises eluting the unbound RNA from the solid support.

In some embodiments, the method comprises heating the composition. In some embodiments, the method comprises buffer exchange. In some embodiments, buffer exchange is performed before the contacting. In some embodiments, buffer exchange is performed after the separating. In some embodiments, buffer exchange is performed before the contacting, and the resulting buffer comprises greater than 1 mM monovalent salt. In some embodiments, the monovalent salt is NaCl or KCl. In some embodiments, the resulting buffer comprises Tris. In some embodiments, the resulting buffer comprises EDTA. In some embodiments, buffer exchange is performed after the separating into storage buffer, wherein the storage buffer comprises 1 mM sodium citrate, pH 6.5. In some embodiments, the method comprises filtering the circular RNA after the separating.

BRIEF DESCRIPTION OF THE DRAWINGS

FIG. 27A shows the proton nuclear magnetic resonance (NMR) spectrum of Lipid Lipid 10a-26. FIG. 27B shows the retention time of Lipid 10a-26 measured by liquid chromatography-mass spectrometry (LC-MS). FIG. 27C shows the mass spectrum of Lipid 10a-26. FIG. 27D shows the proton NMR spectrum of Lipid 10a-27. FIG. 27E shows the retention time of Lipid 10a-27 measured by LC-MS. FIG. 27F shows the mass spectrum of Lipid 10a-27.

FIG. 28A depicts the NMR spectrum of 2-(tetradecylthio)ethan-1-ol. FIG. 28B depicts the NMR spectrum of 2-(tetradecylthio) ethyl acrylate. FIG. 28C depicts the NMR spectrum of bis(2-(tetradecylthio)ethyl) 3,3'-((3-(2-methyl-1H-imidazol-1-yl)propyl)azanediyl)dipropionate (Lipid 22-S14).

FIG. 30A shows the proton NMR spectrum of Lipid 10a-54. FIG. 30B shows the retention time of Lipid 10a-54 measured by LC-MS. FIG. 30C shows the mass spectrum of Lipid 10a-54.

FIGS. 31A-31C depict molecular characterization of heptadecan-9-yl 8-((3-(1H-imidazol-1-yl)propyl)(8-(nonyloxy)-8-oxooctyl)amino)octanoate (Lipid 10a-53). FIG. 31A shows the proton NMR spectrum of Lipid 10a-53. FIG. 31B shows the retention time of Lipid 10a-53 measured by LC-MS. FIG. 31C shows the mass spectrum of Lipid 10a-53.

FIGS. 36A-36D depict images highlighting the luminescence of organs harvested from c57BL/6J mice dosed with circular RNA encoding FLuc and encapsulated in lipid nanoparticles formed with Lipid 10b-15 (FIG. 36A), Lipid 10a-53 (FIG. 36B), or Lipid 10a-54 (FIG. 36C). PBS was used as control (FIG. 36D).

FIGS. 62A-62C show single dose of mOX40L in LNPs transfected with circular RNAs capable of expressing mOX40L. FIGS. 62A and 62B provide percent of mOX40L expression in splenic T cells, CD4+ T cells, CD8+ T cells, B cells, NK cells, dendritic cells, and other myloid cells. FIG. 62C provides mouse weight change 24 hours after transfection.

FIG. 63A quantifies B cell depletion through B220+ B cells of live, CD45+ immune cells and FIG. 63B compares B cell depletion of B220+ B cells of live, CD45+ immune cells in comparison to luciferase expressing circular RNAs. FIG. 63C provides B cell weight gain of the transfected cells.

FIG. 65A shows anti-CD19 CAR geometric mean florescence intensity, FIG. 65B shows percentage of anti-CD19 CAR expression, and FIG. 65C shows the percentage target cell lysis performed by the anti-CD19 CAR. (CK=Caprine Kobuvirus; AP=Apodemus Picornavirus; CK*=Caprine Kobuvirus with codon optimization; PV=Parabovirus; SV=Salivirus.)

FIG. 68A, FIG. 68B, and FIG. 68G provide *Gaussia* luciferase expression in multiple donor cells. FIG. 68C, FIG. 68D, FIG. 68E, and FIG. 68F provides firefly luciferase expression in multiple donor cells.

FIG. 70A shows Nalm6 cell lysing with an anti-CD19 CAR. FIG. 70B shows K562 cell lysing with an anti-CD19 CAR.

FIG. 71A showed the live-dead results. FIG. 71B, FIG. 71C, FIG. 71D, and FIG. 71E provide the frequency of expression for multiple donors.

FIG. 73A shows the in vitro transcription product of the ~4.5 kb SARS-CoV2 spike-encoding circRNA. FIG. 73B shows a histogram of spike protein surface expression via flow cytometry after transfection of spike-encoding circRNA into 293 cells. Transfected 293 cells were stained 24 hours after transfection with CR3022 primary antibody and APC-labeled secondary antibody. FIG. 73C shows a flow cytometry plot of spike protein surface expression on 293 cells after transfection of spike-encoding circRNA. Transfected 293 cells were stained 24 hours after transfection with CR3022 primary antibody and APC-labeled secondary antibody.

FIG. 75A provides a live whole body flux post a 6 hour period and 75B provides whole body IVIS 6 hours following a 1 μg dose of the LNP-circular RNA construct. FIG. 75C provides an ex vivo expression distribution over a 24-hour period.

FIG. 76A provides hEPO titers from a single and mixed set of LNP containing circular RNA constructs, while FIG. 76B provides total flux of bioluminescence expression from single or mixed set of LNP containing circular RNA constructs.

FIG. 77A shows frequency of spike CoV2 expression;

FIG. 77B shows geometric mean fluorescence intensity (gMFI) of the spike CoV2 expression; and FIG. 77C compares gMFI expression of the construct to the frequency of expression.

FIG. 89A shows a linear RNA polynucleotide comprising an accessory element (70) at the spacer regions. FIG. 89B shows a linear RNA polynucleotide comprising an accessory element (70) located between each of the external duplex regions and the exon fragments. FIG. 89C depicts an accessory element (70) within a spacer. FIG. 89D illustrates various iterations of an accessory element (70) located within the core functional element. FIG. 89E illustrates an accessory element (70) located within an internal ribosome entry site (IRES).

FIG. 95A provides the data related to cells received from human donor 1; FIG. 95B provides the data related to cell received from human donor 2.

In FIG. 96A circular RNA encoding for firefly luciferase and linear mRNA encoding for firefly luciferase was tested for expression. In FIG. 96B, human and mouse cells were given circular RNAs encoding for ATP7B proteins. Some of the circular RNAs tested were codon optimized. Circular RNA expressing firefly luciferase was used for comparison.

FIG. 97B shows an exemplary chromatogram showing peak residence of different species after size exclusion HPLC analysis.

FIG. 99A and FIG. 99B depict an exemplary negative selection purification method for circular RNA molecule such as oRNA. The schematic shown in FIG. 99A depicts enzymatic polyadenylation of in vitro transcription reaction products containing oRNA and linear RNA, resulting in polyadenylation (e.g., via addition of a polyA sequence of SEQ ID NO: 3778) of only the linear RNA. The mixture of linear and circular RNA is washed over beads conjugated to deoxythymidine oligonucleotides ("Oligo dT"; e.g., SEQ ID NO: 3779) under specific buffer conditions. Polyadenylated linear RNA anneals to the beads while oRNA flows through for collection. FIG. 99B shows exemplary SEC-HPLC chromatograms of in vitro transcription (IVT) reaction products prior to polyadenylation and purification (left panel) and of the eluant following polyadenylation using $E.\ coli$ polyA polymerase and purification with oligo-dT beads in binding buffer (right panel).

FIG. 100A shows such Xrn1 and RNaseR digestion of linear RNA. FIG. 100B shows exemplary SEC-HPLC chromatograms of IVT reaction products prior to enzymatic digestion (left pane) and of the final, enzymatically purified material (right panel).

In FIG. 101, "IVT" indicates an unpurified reaction mixture; "+GMP" indicates an unpurified reaction mixture in which the in vitro transcription was performed in the presence of 12.5-fold GMP relative to GTP; "+HPLC" indicates a reaction mixture purified by HPLC; "+HPLC/GMP" indicates a reaction mixture purified by HPLC in which the in vitro transcription was performed in the presence of 12.5-fold GMP relative to GTP; "3phpRNA" indicates a positive control comprising a triphosphate hairpin RNA (tlrl-hprna, Invivogen); and "mock" indicates a preparation containing no RNA. FIG. 101A shows immune stimulation of HeLa cells, and FIG. 101B shows immune stimulation of A594 cells.

FIG. 102A provides representative dot plots from FACs analysis of human T cell expression of CD19-41BBζ, CD19-CD28ζ, HER2-41BBζ, and HER2-CD28ζ CARs. FIG. 102B depicts cumulative data for the MFI of CD19-41BBζ, CD19-CD28ζ, HER2-41BBζ, and HER2-CD28ζ expression collected via fluorescence-activated cell sorting (FACS).

FIG. 103A provides the % specific lysis of tumor cells after coculture with T cells expressing oRNA encoding CD19-41BBζ, CD19-CD28ζ, HER2-41BBζ, and HER2-CD28ζ CARs in comparison to T cells expressing a circular RNA encoding mOX40L. FIGS. 103B and 103C depict IFN-g and IL-2 cytokine in pg/mL, respectively, secreted by T cells expressing the listed oRNA as compared to a circular RNA encoding mOX40L after co-cultured with tumor cells.

FIG. 104A depicts mOX40L detection in T cells in the spleen of the humanized mice. FIG. 104B depicts mOX40L detection in T cells in the peripheral blood of the humanized mice.

FIG. 106A illustrates killing of Nalm6 tumor cells after co-culture of T cells transfected with LNP-oRNA constructs encoding CARs of CD19-41BBζ and CD19-CD28ζ CARs along with HER2-41BBz, HER2-CD28z, or the control LNP-oRNA mOX40L. FIG. 106B provides mean fluorescence intensity (MFI) of the CAR surface expression on T cells treated with the LNP-oRNA CAR constructs.

DETAILED DESCRIPTION

Figure 1A:
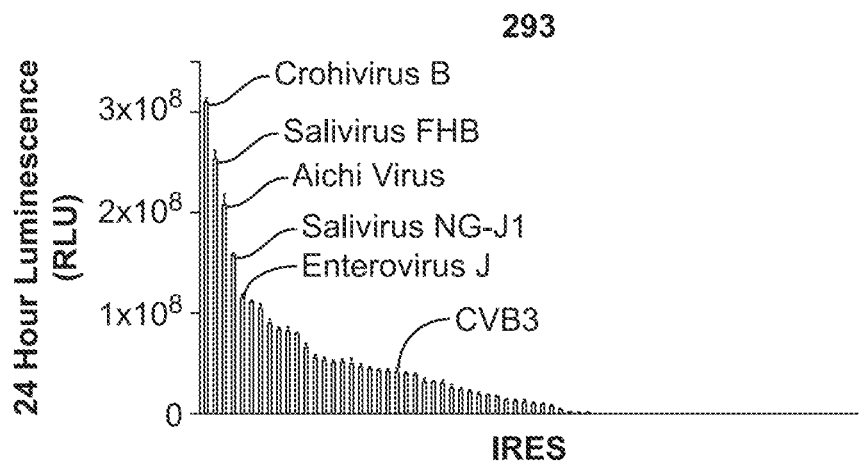
FIGS. 1A-1E depict luminescence in supernatants of HEK293 (FIGS. 1A, 1D, and 1E), HepG2 (FIG. 1B), or 1C1C7 (FIG. 1C) cells 24 hours after transfection with circular RNA comprising a *Gaussia* luciferase expression sequence and various IRES sequences.
Figure 1B:
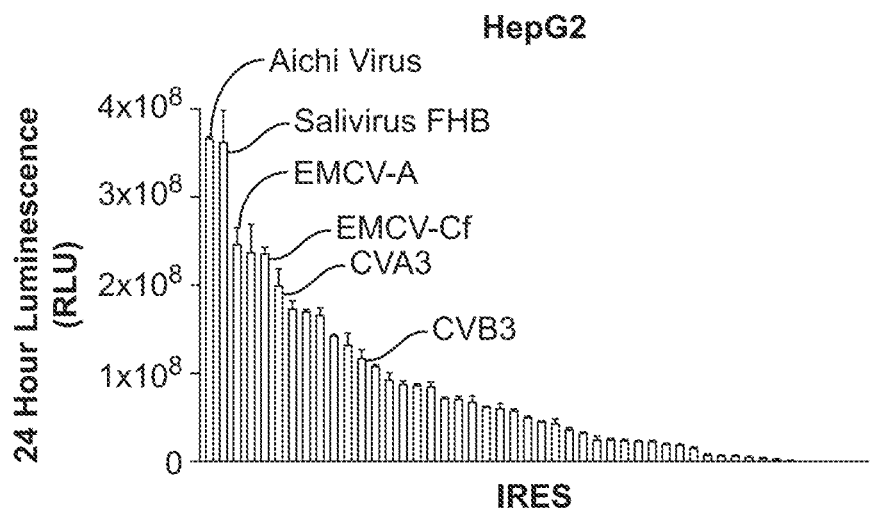

The present invention provides, among other things, methods and compositions for treating an autoimmune disorder, deficiency disease, or cancer based on circular RNA therapy. In particular, the present invention provides methods for treating an autoimmune disorder, deficiency disease, or cancer by administering to a subject in need of treatment a composition comprising a circular RNA encoding at least one therapeutic protein at an effective dose and an administration interval such that at least one symptom or feature of the relevant disease or disorder is reduced in intensity, severity, or frequency or is delayed in onset.

As disclosed herein, the improved circular RNA therapy, along with associated compositions and methods, allows for increased circular RNA stability, expression, and prolonged half-life, among other things. In some embodiments, the inventive circular RNA is transcribed from a linear RNA polynucleotide construct comprising enhanced intron elements, enhanced exon elements, and a core functional element. The enhanced intron element, in some embodiments, comprises post splicing group I intron fragments, spacers, duplex sequences, affinity sequences, and unique untranslated sequences that allows for optimal circularization. In some embodiments, the enhanced exon element comprises an exon fragment, spacers and duplex sequences to aid with the circularization process and for maintaining stability of the circular RNA post circularization. Within the same embodiments, the core functional element includes the essential elements for protein translation of a translation initiation element (TIE), a coding or noncoding element, and a termination sequence (e.g., a stop codon or stop cassette). Together, the enhanced intron elements, enhanced exon elements, and core functional element comprising a coding element provides an optimal circular RNA polynucleotide for encoding a therapeutic protein. In one embodiment, the enhanced intron elements, enhanced exon elements, and core functional element comprising a noncoding element provides an optimal circular RNA polynucleotide for triggering an immune system as an adjuvant.

Also disclosed herein is a DNA template (e.g., a vector) for making circular RNA. In some embodiments, the DNA template comprises a 3' enhanced intron fragment, a 3' enhanced exon fragment, a core functional element, a 5' enhanced exon fragment, and a 5' enhanced intron fragment. In some embodiments, these elements are positioned in the DNA template in the above order.

Additional embodiments include circular RNA polynucleotides, including circular RNA polynucleotides (e.g., a circular RNA comprising 3' enhanced exon element, a core functional element, and a 5' enhanced exon element) made using the DNA template provided herein, compositions comprising such circular RNA, cells comprising such circular RNA, methods of using and making such DNA template, circular RNA, compositions and cells.

In some embodiments, provided herein are methods comprising administration of circular RNA polynucleotides provided herein into cells for therapy or production of useful proteins. In some embodiments, the method is advantageous in providing the production of a desired polypeptide inside eukaryotic cells with a longer half-life than linear RNA, due to the resistance of the circular RNA to ribonucleases.

Circular RNA polynucleotides lack the free ends necessary for exonuclease-mediated degradation, causing them to be resistant to several mechanisms of RNA degradation and granting extended half-lives when compared to an equivalent linear RNA. Circularization may allow for the stabilization of RNA polynucleotides that generally suffer from short half-lives and may improve the overall efficacy of exogenous mRNA in a variety of applications. In an embodiment, the functional half-life of the circular RNA polynucleotides provided herein in eukaryotic cells (e.g., mammalian cells, such as human cells) as assessed by protein synthesis is at least 20 hours (e.g., at least 80 hours).

Various aspects of the invention are described in detail in the following sections. The use of sections is not meant to limit the invention. Each section can apply to any aspect of the invention. In this application, the use of "or" means "and/or" unless stated otherwise.

1. Definitions

As used herein, the term "circRNA," "circular polyribonucleotide," "circular RNA," "circularized RNA," or "oRNA" are used interchangeably and refers to a polyribonucleotide that forms a circular structure through covalent bonds. As used herein, such terms also include preparations comprising circRNA, circular polyribonucleotides, circular RNAs or oRNAs.

As used herein, the term "DNA template" refers to a DNA sequence capable of transcribing a linear RNA polynucleotide. For example, but not intending to be limiting, a DNA template may include a DNA vector, PCR product or plasmid.

As used herein, the term "3' group I intron fragment" refers to a sequence with 75% or higher similarity to the 3'-proximal end of a natural group I intron including the splice site dinucleotide.

As used herein, the term "5' group I intron fragment" refers to a sequence with 75% or higher similarity to the 5'-proximal end of a natural group I intron including the splice site dinucleotide.

As used herein, the term "permutation site" refers to the site in a group I intron where a cut is made prior to permutation of the intron. This cut generates 3' and 5' group I intron fragments that are permuted to be on either side of a stretch of precursor RNA to be circularized.

As used herein, the term "splice site" refers to a dinucleotide that is partially or fully included in a group I intron and between which a phosphodiester bond is cleaved during RNA circularization. (As used herein, "splice site" refers to the dinucleotide or dinucleotides between which cleavage of the phosphodiester bond occurs during a splicing reaction. A "5' splice site" refers to the natural 5' dinucleotide of the intron e.g., group I intron, while a "3' splice site" refers to the natural 3' dinucleotide of the intron).

As used herein, the term "expression sequence" refers to a nucleic acid sequence that encodes a product, e.g., a peptide or polypeptide, regulatory nucleic acid, or non-coding nucleic acid. An exemplary expression sequence that codes for a peptide or polypeptide can comprise a plurality of nucleotide triads, each of which can code for an amino acid and is termed as a "codon."

As used herein, "coding element" or "coding region" is region located within the expression sequence and encodings for one or more proteins or polypeptides (e.g., therapeutic protein).

As used herein, a "noncoding element" or "non-coding nucleic acid" is a region located within the expression sequence. This sequence, but itself does not encode for a protein or polypeptide, but may have other regulatory functions, including but not limited, allow the overall polynucleotide to act as a biomarker or adjuvant to a specific cell.

As used herein, the term "therapeutic protein" refers to any protein that, when administered to a subject directly or indirectly in the form of a translated nucleic acid, has a therapeutic, diagnostic, and/or prophylactic effect and/or elicits a desired biological and/or pharmacological effect.

As used herein, the term "immunogenic" refers to a potential to induce an immune response to a substance. An immune response may be induced when an immune system of an organism or a certain type of immune cells is exposed to an immunogenic substance. The term "non-immunogenic" refers to a lack of or absence of an immune response above a detectable threshold to a substance. No immune response is detected when an immune system of an organism or a certain type of immune cells is exposed to a non-immunogenic substance. In some embodiments, a non-immunogenic circular polyribonucleotide as provided herein, does not induce an immune response above a pre-determined threshold when measured by an immunogenicity assay. In some embodiments, no innate immune response is detected when an immune system of an organism or a certain type of immune cells is exposed to a non-immunogenic circular polyribonucleotide as provided herein. In some embodiments, no adaptive immune response is detected when an immune system of an organism or a certain type of immune cell is exposed to a non-immunogenic circular polyribonucleotide as provided herein.

As used herein, the term "circularization efficiency" refers to a measurement of the rate of formation of amount of resultant circular polyribonucleotide as compared to its linear starting material.

As used herein, the term "translation efficiency" refers to a rate or amount of protein or peptide production from a ribonucleotide transcript. In some embodiments, translation efficiency can be expressed as amount of protein or peptide produced per given amount of transcript that codes for the protein or peptide.

The term "nucleotide" refers to a ribonucleotide, a deoxyribonucleotide, a modified form thereof, or an analog thereof. Nucleotides include species that comprise purines, e.g., adenine, hypoxanthine, guanine, and their derivatives and analogs, as well as pyrimidines, e.g., cytosine, uracil, thymine, and their derivatives and analogs. Nucleotide analogs include nucleotides having modifications in the chemical structure of the base, sugar and/or phosphate, including, but not limited to, 5'-position pyrimidine modifications, 8'-position purine modifications, modifications at cytosine exocyclic amines, and substitution of 5-bromo-uracil; and 2'-position sugar modifications, including but not limited to, sugar-modified ribonucleotides in which the 2'-OH is replaced by a group such as an H, OR, R, halo, SH, SR, NH2, NHR, NR2, or CN, wherein R is an alkyl moiety as defined herein. Nucleotide analogs are also meant to include nucleotides with bases such as inosine, queuosine, xanthine; sugars such as 2'-methyl ribose; non-natural phosphodiester linkages such as methylphosphonate, phosphorothioate and peptide linkages. Nucleotide analogs include 5-methoxyuridine, 1-methylpseudouridine, and 6-methyladenosine.

The terms "nucleic acid" and "polynucleotide" are used interchangeably herein to describe a polymer of any length, e.g., greater than about 2 bases, greater than about 10 bases, greater than about 100 bases, greater than about 500 bases, greater than 1000 bases, or up to about 10,000 or more bases, composed of nucleotides, e.g., deoxyribonucleotides or ribonucleotides, and may be produced enzymatically or synthetically (e.g., as described in U.S. Pat. No. 5,948,902 and the references cited therein), which can hybridize with naturally occurring nucleic acids in a sequence specific manner analogous to that of two naturally occurring nucleic acids, e.g., can participate in Watson-Crick base pairing interactions. An "oligonucleotide" is a polynucleotide comprising fewer than 1000 nucleotides, such as a polynucleotide comprising fewer than 500 nucleotides or fewer than 100 nucleotides. Naturally occurring nucleic acids are comprised of nucleotides, including guanine, cytosine, adenine, thymine, and uracil containing nucleotides (G, C, A, T, and U respectively). As used herein, "polyA" means a polynucleotide or a portion of a polynucleotide consisting of nucleotides comprising adenine. As used herein, "polyT" means a polynucleotide or a portion of a polynucleotide consisting of nucleotides comprising thymine. As used herein, "polyAC" means a polynucleotide or a portion of a polynucleotide consisting of nucleotides comprising adenine or cytosine.

The terms "ribonucleic acid" and "RNA" as used herein mean a polymer composed of ribonucleotides.

The terms "deoxyribonucleic acid" and "DNA" as used herein mean a polymer composed of deoxyribonucleotides.

"Isolated" or "purified" generally refers to isolation of a substance (for example, in some embodiments, a compound, a polynucleotide, a protein, a polypeptide, a polynucleotide composition, or a polypeptide composition) such that the substance comprises a significant percent (e.g., greater than 1%, greater than 2%, greater than 5%, greater than 10%, greater than 20%, greater than 50%, or more, usually up to about 90%-100%) of the sample in which it resides. In certain embodiments, a substantially purified component comprises at least 50, 60, 70, 75, 80, 85, 90, 95, 96, 97, 98, or 99% of the sample. In additional embodiments, a substantially purified component comprises about, 80%-85%, or 90%-95%, 95-99%, 96-99%, 97-99%, or 95-100% of the sample. Techniques for purifying polynucleotides and polypeptides of interest are well-known in the art and include, for example, ion-exchange chromatography, affinity chromatography and sedimentation according to density. Generally, a substance is purified when it exists in a sample in an amount, relative to other components of the sample, that is more than as it is found naturally.

The terms "duplexed," "double-stranded," or "hybridized" as used herein refer to nucleic acids formed by hybridization of two single strands of nucleic acids containing complementary sequences. In most cases, genomic DNA is double-stranded. Sequences can be fully complementary or partially complementary.

As used herein, "unstructured" with regard to RNA refers to an RNA sequence that is not predicted by RNA structure predictive tools to form a structure (e.g., a hairpin loop) with itself or other sequences in the same RNA molecule. In some embodiments, unstructured RNA can be functionally characterized using nuclease protection assays.

As used herein, "structured" with regard to RNA refers to an RNA sequence that is predicted by the RNAFold software or similar predictive tools to form a structure (e.g., a hairpin loop) with itself or other sequences in the same RNA molecule.

As used herein, two "duplex sequences," "duplex region," "duplex regions," "homology arms," or "homology regions" may be any two regions that are thermodynamically favored to cross-pair in a sequence specific interaction. In some embodiments, two duplex sequences, duplex regions, homology arms, or homology regions, share a sufficient level of sequence identity to one another's reverse complement to act as substrates for a hybridization reaction. As used herein polynucleotide sequences have "homology" when they are either identical or share sequence identity to a reverse complement or "complementary" sequence. The percent sequence identity between a homology region and a counterpart homology region's reverse complement can be any percent of sequence identity that allows for hybridization to occur. In some embodiments, an internal duplex region of an inventive polynucleotide is capable of forming a duplex with another internal duplex region and does not form a duplex with an external duplex region.

As used herein, an "affinity sequence" or "affinity tag" is a region of polynucleotide sequences polynucleotide sequence ranging from 1 nucleotide to hundreds or thousands of nucleotides containing a repeated set of nucleotides for the purposes of aiding purification of a polynucleotide sequence. For example, an affinity sequence may comprise, but is not limited to, a polyA or polyAC sequence. In some embodiments, affinity tags are used in purification methods, referred to herein as "affinity-purification," in which selective binding of a binding agent to molecules comprising an affinity tag facilitates separation from molecules that do not comprise an affinity tag. In some embodiments, an affinity-purification method is a "negative selection" purification method, in which unwanted species, such as linear RNA, are selectively bound and removed and wanted species, such as circular RNA, are eluted and separated from unwanted species.

As used herein, a "spacer" refers to a region of a polynucleotide sequence ranging from 1 nucleotide to hundreds or thousands of nucleotides separating two other elements along a polynucleotide sequence. The sequences can be defined or can be random. A spacer is typically non-coding. In some embodiments, spacers include duplex regions.

Linear nucleic acid molecules are said to have a "5'-terminus" (5' end) and a "3'-terminus" (3' end) because nucleic acid phosphodiester linkages occur at the 5' carbon and 3' carbon of the sugar moieties of the substituent mononucleotides. The end nucleotide of a polynucleotide at which a new linkage would be to a 5' carbon is its 5' terminal nucleotide. The end nucleotide of a polynucleotide at which a new linkage would be to a 3' carbon is its 3' terminal nucleotide. A terminal nucleotide, as used herein, is the nucleotide at the end position of the 3'- or 5'-terminus.

As used herein, a "leading untranslated sequence" is a region of polynucleotide sequences ranging from 1 nucleotide to hundreds of nucleotides located at the upmost 5' end of a polynucleotide sequence. The sequences can be defined or can be random. An leading untranslated sequence is non-coding.

As used herein, a "terminal untranslated sequence" is a region of polynucleotide sequences ranging from 1 nucleotide to hundreds of nucleotides located at the downmost 3' end of a polynucleotide sequence. The sequences can be defined or can be random. A terminal untranslated sequence is non-coding.

"Transcription" means the formation or synthesis of an RNA molecule by an RNA polymerase using a DNA molecule as a template. The invention is not limited with respect to the RNA polymerase that is used for transcription. For example, in some embodiments, a T7-type RNA polymerase can be used.

"Translation" means the formation of a polypeptide molecule by a ribosome based upon an RNA template.

It is to be understood that the terminology used herein is for the purpose of describing particular embodiments only, and is not intended to be limiting. As used in this specification and the appended claims, the singular forms "a," "an," and "the" include plural referents unless the content clearly dictates otherwise. Thus, for example, reference to "a cell" includes combinations of two or more cells, or entire cultures of cells; reference to "a polynucleotide" includes, as a practical matter, many copies of that polynucleotide. Unless specifically stated or obvious from context, as used herein, the term "or" is understood to be inclusive. Unless defined herein and below in the reminder of the specification, all technical and scientific terms used herein have the same meaning as commonly understood by one of ordinary skill in the art to which the invention pertains.

Unless specifically stated or obvious from context, as used herein, the term "about," is understood as within a range of normal tolerance in the art, for example within 2 standard deviations of the mean. "About" can be understood as within 10%, 9%, 8%, 7%, 6%, 5%, 4%, 3%, 2%, 1%, 0.9%, 0.8%, 0.7%, 0.6%, 0.5%, 0.4%, 0.3%, 0.2%, 0.1%, 0.09%, 0.08%, 0.07%, 0.06%, 0.05%, 0.04%, 0.03%, 0.02%, or 0.01% of the stated value. Unless otherwise clear from the context, all numerical values provided herein are modified by the term "about."

As used herein, the term "encode" refers broadly to any process whereby the information in a polymeric macromolecule is used to direct the production of a second molecule that is different from the first. The second molecule may have a chemical structure that is different from the chemical nature of the first molecule.

By "co-administering" is meant administering a therapeutic agent provided herein in conjunction with one or more additional therapeutic agents sufficiently close in time such that the therapeutic agent provided herein can enhance the effect of the one or more additional therapeutic agents, or vice versa.

The terms "treat," and "prevent" as well as words stemming therefrom, as used herein, do not necessarily imply 100% or complete treatment or prevention. Rather, there are varying degrees of treatment or prevention of which one of ordinary skill in the art recognizes as having a potential benefit or therapeutic effect. The treatment or prevention provided by the method disclosed herein can include treatment or prevention of one or more conditions or symptoms of the disease. Also, for purposes herein, "prevention" can encompass delaying the onset of the disease, or a symptom or condition thereof.

As used herein, "aptamer" refers in general to either an oligonucleotide of a single defined sequence or a mixture of said nucleotides, wherein the mixture retains the properties of binding specifically to the target molecule (e.g., eukaryotic initiation factor, 40S ribosome, polyC binding protein, polyA binding protein, polypyrimidine tract-binding protein, argonaute protein family, Heterogeneous nuclear ribonucleoprotein K and La and related RNA-binding protein). Thus, as used herein "aptamer" denotes both singular and plural sequences of nucleotides, as defined hereinabove. The term "aptamer" is meant to refer to a single- or double-stranded nucleic acid which is capable of binding to a protein or other molecule. In general, aptamers preferably comprise about 10 to about 100 nucleotides, preferably about 15 to about 40 nucleotides, more preferably about 20 to about 40 nucleotides, in that oligonucleotides of a length that falls within these ranges are readily prepared by conventional techniques. Optionally, aptamers can further comprise a minimum of approximately 6 nucleotides, preferably 10, and more preferably 14 or 15 nucleotides, that are necessary to effect specific binding.

An "eukaryotic initiation factor" or "eIF" refers to a protein or protein complex used in assembling an initiator tRNA, 40S and 60S ribosomal subunits required for initiating eukaryotic translation.

As used herein, an "internal ribosome entry site" or "IRES" refers to an RNA sequence or structural element ranging in size from 10 nt to 1000 nt or more, capable of initiating translation of a polypeptide in the absence of a typical RNA cap structure. An IRES is typically about 500 nt to about 700 nt in length.

As used herein, a "miRNA site" refers to a stretch of nucleotides within a polynucleotide that is capable of forming a duplex with at least 8 nucleotides of a natural miRNA sequence.

As used herein, an "endonuclease site" refers to a stretch of nucleotides within a polynucleotide that is capable of being recognized and cleaved by an endonuclease protein.

As used herein, "bicistronic RNA" refers to a polynucleotide that includes two expression sequences coding for two distinct proteins. These expression sequences can be separated by a nucleotide sequence encoding a cleavable peptide such as a protease cleavage site. They can also be separated by a ribosomal skipping element.

As used herein, the term "ribosomal skipping element" refers to a nucleotide sequence encoding a short peptide sequence capable of causing generation of two peptide chains from translation of one RNA molecule. While not wishing to be bound by theory, it is hypothesized that ribosomal skipping elements function by (1) terminating translation of the first peptide chain and re-initiating translation of the second peptide chain; or (2) cleavage of a peptide bond in the peptide sequence encoded by the ribosomai skipping element by an intrinsic protease activity of the encoded peptide, or by another protease in the environment (e.g., cytosol).

As used herein, the term "co-formulate" refers to a nanoparticle formulation comprising two or more nucleic acids or a nucleic acid and other active drug substance. Typically, the ratios are equimolar or defined in the ratiometric amount of the two or more nucleic acids or the nucleic acid and other active drug substance.

As used herein, "transfer vehicle" includes any of the standard pharmaceutical carriers, diluents, excipients, and the like, which are generally intended for use in connection with the administration of biologically active agents, including nucleic acids.

As used herein, the phrase "lipid nanoparticle" refers to a transfer vehicle comprising one or more cationic or ionizable lipids, stabilizing lipids, structural lipids, and helper lipids.

As used herein, the phrase "ionizable lipid" refers to any of a number of lipid species that carry a net positive charge at a selected pH, such as physiological pH 4 and a neutral charge at other pHs such as physiological pH 7.

In some embodiments, a lipid, e.g., an ionizable lipid, disclosed herein comprises one or more cleavable groups. The terms "cleave" and "cleavable" are used herein to mean that one or more chemical bonds (e.g., one or more of covalent bonds, hydrogen-bonds, van der Waals' forces and/or ionic interactions) between atoms in or adjacent to the subject functional group are broken (e.g., hydrolyzed) or are capable of being broken upon exposure to selected conditions (e.g., upon exposure to enzymatic conditions). In certain embodiments, the cleavable group is a disulfide functional group, and in particular embodiments is a disulfide group that is capable of being cleaved upon exposure to selected biological conditions (e.g., intracellular conditions). In certain embodiments, the cleavable group is an ester functional group that is capable of being cleaved upon exposure to selected biological conditions. For example, the disulfide groups may be cleaved enzymatically or by a hydrolysis, oxidation or reduction reaction. Upon cleavage of such disulfide functional group, the one or more functional moieties or groups (e.g., one or more of a head-group and/or a tail-group) that are bound thereto may be liberated. Exemplary cleavable groups may include, but are not limited to, disulfide groups, ester groups, ether groups, and any derivatives thereof (e.g., alkyl and aryl esters). In certain embodiments, the cleavable group is not an ester group or an ether group. In some embodiments, a cleavable group is bound (e.g., bound by one or more of hydrogen-bonds, van der Waals' forces, ionic interactions and covalent bonds) to one or more functional moieties or groups (e.g., at least one head-group and at least one tail-group). In certain embodiments, at least one of the functional moieties or groups is hydrophilic (e.g., a hydrophilic head-group comprising one or more of imidazole, guanidinium, amino, imine, enamine, optionally-substituted alkyl amino and pyridyl).

As used herein, the term "hydrophilic" is used to indicate in qualitative terms that a functional group is water-preferring, and typically such groups are water-soluble. For example, disclosed herein are compounds that comprise a cleavable disulfide (S—S) functional group bound to one or more hydrophilic groups (e.g., a hydrophilic head-group), wherein such hydrophilic groups comprise or are selected from the group consisting of imidazole, guanidinium, amino, imine, enamine, an optionally-substituted alkyl amino (e.g., an alkyl amino such as dimethylamino) and pyridyl.

In certain embodiments, at least one of the functional groups of moieties that comprise the compounds disclosed herein is hydrophobic in nature (e.g., a hydrophobic tail-group comprising a naturally occurring lipid such as cholesterol). As used herein, the term "hydrophobic" is used to indicate in qualitative terms that a functional group is water-avoiding, and typically such groups are not water soluble. For example, disclosed herein are compounds that comprise a cleavable functional group (e.g., a disulfide (S—S) group) bound to one or more hydrophobic groups, wherein such hydrophobic groups comprise one or more naturally occurring lipids such as cholesterol, and/or an optionally substituted, variably saturated or unsaturated C6-C20 alkyl and/or an optionally substituted, variably saturated or unsaturated C6-C20 acyl.

Compound described herein may also comprise one or more isotopic substitutions. For example, H may be in any isotopic form, including 1H, 2H (D or deuterium), and 3H (T or tritium); C may be in any isotopic form, including 12C, 13C, and 14C; O may be in any isotopic form, including 16O and 18O; F may be in any isotopic form, including 18F and 19F; and the like.

When describing the invention, which may include compounds and pharmaceutically acceptable salts thereof, pharmaceutical compositions containing such compounds and methods of using such compounds and compositions, the following terms, if present, have the following meanings unless otherwise indicated. It should also be understood that when described herein any of the moieties defined forth below may be substituted with a variety of substituents, and that the respective definitions are intended to include such substituted moieties within their scope as set out below. Unless otherwise stated, the term "substituted" is to be defined as set out below. It should be further understood that the terms "groups" and "radicals" can be considered interchangeable when used herein.

When a range of values is listed, it is intended to encompass each value and sub-range within the range. For example, "C1-6 alkyl" is intended to encompass, C1, C2, C3, C4, C5, C6, C1-6, C1-5, C1-4, C1-3, C1-2, C2-6, C2-5, C2-4, C2-3, C3-6, C3-5, C3-4, C4-6, C4-5, and C5-6 alkyl.

In certain embodiments, the compounds disclosed herein comprise, for example, at least one hydrophilic head-group and at least one hydrophobic tail-group, each bound to at least one cleavable group, thereby rendering such compounds amphiphilic. As used herein to describe a compound or composition, the term "amphiphilic" means the ability to dissolve in both polar (e.g., water) and non-polar (e.g., lipid) environments. For example, in certain embodiments, the compounds disclosed herein comprise at least one lipophilic tail-group (e.g., cholesterol or a C6-C20 alkyl) and at least one hydrophilic head-group (e.g., imidazole), each bound to a cleavable group (e.g., disulfide).

It should be noted that the terms "head-group" and "tail-group" as used describe the compounds of the present invention, and in particular functional groups that comprise such compounds, are used for ease of reference to describe the orientation of one or more functional groups relative to other functional groups. For example, in certain embodiments a hydrophilic head-group (e.g., guanidinium) is bound (e.g., by one or more of hydrogen-bonds, van der Waals' forces, ionic interactions and covalent bonds) to a cleavable functional group (e.g., a disulfide group), which in turn is bound to a hydrophobic tail-group (e.g., cholesterol).

As used herein, the term "alkyl" refers to both straight and branched chain C1-C40 hydrocarbons (e.g., C6-C20 hydrocarbons), and include both saturated and unsaturated hydrocarbons. In certain embodiments, the alkyl may comprise one or more cyclic alkyls and/or one or more heteroatoms such as oxygen, nitrogen, or sulfur and may optionally be substituted with substituents (e.g., one or more of alkyl, halo, alkoxyl, hydroxy, amino, aryl, ether, ester or amide). In certain embodiments, a contemplated alkyl includes (9Z, 12Z)-octadeca-9,12-dien. The use of designations such as, for example, "C6-C20" is intended to refer to an alkyl (e.g., straight or branched chain and inclusive of alkenes and alkyls) having the recited range carbon atoms. In some embodiments, an alkyl group has 1 to 10 carbon atoms ("C1-10 alkyl"). In some embodiments, an alkyl group has 1 to 9 carbon atoms ("C1-9 alkyl"). In some embodiments, an alkyl group has 1 to 8 carbon atoms ("C1-8 alkyl"). In some embodiments, an alkyl group has 1 to 7 carbon atoms ("C1-7 alkyl"). In some embodiments, an alkyl group has 1 to 6 carbon atoms ("C1-6 alkyl"). In some embodiments, an alkyl group has 1 to 5 carbon atoms ("C1-5 alkyl"). In some embodiments, an alkyl group has 1 to 4 carbon atoms ("C1-4 alkyl"). In some embodiments, an alkyl group has 1 to 3 carbon atoms ("C1-3 alkyl"). In some embodiments, an alkyl group has 1 to 2 carbon atoms ("C1-2 alkyl"). In some embodiments, an alkyl group has 1 carbon atom ("C1 alkyl"). Examples of C1-6 alkyl groups include methyl, ethyl, propyl, isopropyl, butyl, isobutyl, pentyl, hexyl, and the like.

As used herein, "alkenyl" refers to a radical of a straight-chain or branched hydrocarbon group having from 2 to 20 carbon atoms, one or more carbon-carbon double bonds (e.g., 1, 2, 3, or 4 carbon-carbon double bonds), and optionally one or more carbon-carbon triple bonds (e.g., 1, 2, 3, or 4 carbon-carbon triple bonds) ("C2-20 alkenyl"). In certain embodiments, alkenyl does not contain any triple bonds. In some embodiments, an alkenyl group has 2 to 10 carbon atoms ("C2-10 alkenyl"). In some embodiments, an alkenyl group has 2 to 9 carbon atoms ("C2-9 alkenyl"). In some embodiments, an alkenyl group has 2 to 8 carbon atoms ("C2-8 alkenyl"). In some embodiments, an alkenyl group has 2 to 7 carbon atoms ("C2-7 alkenyl"). In some embodiments, an alkenyl group has 2 to 6 carbon atoms ("C2-6 alkenyl"). In some embodiments, an alkenyl group has 2 to 5 carbon atoms ("C2-5 alkenyl"). In some embodiments, an alkenyl group has 2 to 4 carbon atoms ("C2-4 alkenyl"). In some embodiments, an alkenyl group has 2 to 3 carbon atoms ("C2-3 alkenyl"). In some embodiments, an alkenyl group has 2 carbon atoms ("C2 alkenyl"). The one or more carbon-carbon double bonds can be internal (such as in 2-butenyl) or terminal (such as in 1-butenyl). Examples of C2-4 alkenyl groups include ethenyl (C2), 1-propenyl (C3), 2-propenyl (C3), 1-butenyl (C4), 2-butenyl (C4), butadienyl (C4), and the like. Examples of C2-6 alkenyl groups include the aforementioned C2-4 alkenyl groups as well as pentenyl (C5), pentadienyl (C5), hexenyl (C6), and the like. Additional examples of alkenyl include heptenyl (C7), octenyl (C8), octatrienyl (C8), and the like.

As used herein, "alkynyl" refers to a radical of a straight-chain or branched hydrocarbon group having from 2 to 20 carbon atoms, one or more carbon-carbon triple bonds (e.g., 1, 2, 3, or 4 carbon-carbon triple bonds), and optionally one or more carbon-carbon double bonds (e.g., 1, 2, 3, or 4 carbon-carbon double bonds) ("C2-20 alkynyl"). In certain embodiments, alkynyl does not contain any double bonds. In some embodiments, an alkynyl group has 2 to 10 carbon atoms ("C2-10 alkynyl"). In some embodiments, an alkynyl group has 2 to 9 carbon atoms ("C2-9 alkynyl"). In some embodiments, an alkynyl group has 2 to 8 carbon atoms ("C2-8 alkynyl"). In some embodiments, an alkynyl group has 2 to 7 carbon atoms ("C2-7 alkynyl"). In some embodiments, an alkynyl group has 2 to 6 carbon atoms ("C2-6 alkynyl"). In some embodiments, an alkynyl group has 2 to 5 carbon atoms ("C2-5 alkynyl"). In some embodiments, an alkynyl group has 2 to 4 carbon atoms ("C2-4 alkynyl"). In some embodiments, an alkynyl group has 2 to 3 carbon atoms ("C2-3 alkynyl"). In some embodiments, an alkynyl group has 2 carbon atoms ("C2 alkynyl"). The one or more carbon-carbon triple bonds can be internal (such as in 2-butynyl) or terminal (such as in 1-butynyl). Examples of C2-4 alkynyl groups include, without limitation, ethynyl (C2), 1-propynyl (C3), 2-propynyl (C3), 1-butynyl (C4), 2-butynyl (C4), and the like. Examples of C2-6 alkenyl groups include the aforementioned C2-4 alkynyl groups as well as pentynyl (C5), hexynyl (C6), and the like. Additional examples of alkynyl include heptynyl (C7), octynyl (C8), and the like.

As used herein, "alkylene," "alkenylene," and "alkynylene," refer to a divalent radical of an alkyl, alkenyl, and alkynyl group respectively. When a range or number of carbons is provided for a particular "alkylene," "alkenylene," or "alkynylene," group, it is understood that the range or number refers to the range or number of carbons in the linear carbon divalent chain. "Alkylene," "alkenylene," and "alkynylene," groups may be substituted or unsubstituted with one or more substituents as described herein.

As used herein, the term "aryl" refers to aromatic groups (e.g., monocyclic, bicyclic and tricyclic structures) containing six to ten carbons in the ring portion. The aryl groups may be optionally substituted through available carbon atoms and in certain embodiments may include one or more heteroatoms such as oxygen, nitrogen or sulfur. In some embodiments, an aryl group has six ring carbon atoms ("C6 aryl"; e.g., phenyl). In some embodiments, an aryl group has ten ring carbon atoms ("C10 aryl"; e.g., naphthyl such as 1-naphthyl and 2-naphthyl).

As used herein, "heteroaryl" refers to a radical of a 5-10 membered monocyclic or bicyclic 4n+2 aromatic ring system (e.g., having 6 or 10 electrons shared in a cyclic array) having ring carbon atoms and 1-4 ring heteroatoms provided in the aromatic ring system, wherein each heteroatom is independently selected from nitrogen, oxygen and sulfur ("5-10 membered heteroaryl"). In heteroaryl groups that contain one or more nitrogen atoms, the point of attachment can be a carbon or nitrogen atom, as valency permits. Heteroaryl bicyclic ring systems can include one or more heteroatoms in one or both rings. "Heteroaryl" includes ring systems wherein the heteroaryl ring, as defined above, is fused with one or more carbocyclyl or heterocyclyl groups wherein the point of attachment is on the heteroaryl ring, and in such instances, the number of ring members continue to designate the number of ring members in the heteroaryl ring system. "Heteroaryl" also includes ring systems wherein the heteroaryl ring, as defined above, is fused with one or more aryl groups wherein the point of attachment is either on the aryl or heteroaryl ring, and in such instances, the number of ring members designates the number of ring members in the fused (aryl/heteroaryl) ring system. Bicyclic heteroaryl groups wherein one ring does not contain a heteroatom (e.g., indolyl, quinolinyl, carbazolyl, and the like) the point of attachment can be on either ring, i.e., either the ring bearing a heteroatom (e.g., 2-indolyl) or the ring that does not contain a heteroatom (e.g., 5-indolyl).

The term "cycloalkyl" refers to a monovalent saturated cyclic, bicyclic, or bridged cyclic (e.g., adamantyl) hydrocarbon group of 3-12, 3-8, 4-8, or 4-6 carbons, referred to herein, e.g., as "C4-8cycloalkyl," derived from a cycloalkane. Exemplary cycloalkyl groups include, but are not limited to, cyclohexanes, cyclopentanes, cyclobutanes and cyclopropanes.

As used herein, "heterocyclyl" or "heterocyclic" refers to a radical of a 3- to 10-membered non-aromatic ring system having ring carbon atoms and 1 to 4 ring heteroatoms, wherein each heteroatom is independently selected from nitrogen, oxygen, sulfur, boron, phosphorus, and silicon ("3-10 membered heterocyclyl"). In heterocyclyl groups that contain one or more nitrogen atoms, the point of attachment can be a carbon or nitrogen atom, as valency permits. A heterocyclyl group can either be monocyclic ("monocyclic heterocyclyl") or a fused, bridged or spiro ring system such as a bicyclic system ("bicyclic heterocyclyl"), and can be saturated or can be partially unsaturated. Heterocyclyl bicyclic ring systems can include one or more heteroatoms in one or both rings. "Heterocyclyl" also includes ring systems wherein the heterocyclyl ring, as defined above, is fused with one or more carbocyclyl groups wherein the point of attachment is either on the carbocyclyl or heterocyclyl ring, or ring systems wherein the heterocyclyl ring, as defined above, is fused with one or more aryl or heteroaryl groups, wherein the point of attachment is on the heterocyclyl ring, and in such instances, the number of ring members continue to designate the number of ring members in the heterocyclyl ring system. The terms "heterocycle," "heterocyclyl," "heterocyclyl ring," "heterocyclic group," "heterocyclic moiety," and "heterocyclic radical," may be used interchangeably.

As used herein, "cyano" refers to —CN.

The terms "halo" and "halogen" as used herein refer to an atom selected from fluorine (fluoro, F), chlorine (chloro, Cl), bromine (bromo, Br), and iodine (iodo, I). In certain embodiments, the halo group is either fluoro or chloro.

The term "alkoxy," as used herein, refers to an alkyl group which is attached to another moiety via an oxygen atom (—O(alkyl)). Non-limiting examples include e.g., methoxy, ethoxy, propoxy, and butoxy.

As used herein, "oxo" refers to —C=O.

In general, the term "substituted", whether preceded by the term "optionally" or not, means that at least one hydrogen present on a group (e.g., a carbon or nitrogen atom) is replaced with a permissible substituent, e.g., a substituent which upon substitution results in a stable compound, e.g., a compound which does not spontaneously undergo transformation such as by rearrangement, cyclization, elimination, or other reaction. Unless otherwise indicated, a "substituted" group has a substituent at one or more substitutable positions of the group, and when more than one position in any given structure is substituted, the substituent is either the same or different at each position.

As used herein, "pharmaceutically acceptable salt" refers to those salts which are, within the scope of sound medical judgment, suitable for use in contact with the tissues of humans and lower animals without undue toxicity, irritation, allergic response and the like, and are commensurate with a reasonable benefit/risk ratio. Pharmaceutically acceptable salts are well known in the art. For example, Berge et al., describes pharmaceutically acceptable salts in detail in J. Pharmaceutical Sciences (1977) 66:1-19. Pharmaceutically acceptable salts of the compounds of this invention include those derived from suitable inorganic and organic acids and bases. Examples of pharmaceutically acceptable, nontoxic acid addition salts are salts of an amino group formed with inorganic acids such as hydrochloric acid, hydrobromic acid, phosphoric acid, sulfuric acid and perchloric acid or with organic acids such as acetic acid, oxalic acid, maleic acid, tartaric acid, citric acid, succinic acid or malonic acid or by using other methods used in the art such as ion exchange. Other pharmaceutically acceptable salts include adipate, alginate, ascorbate, aspartate, benzenesulfonate, benzoate, bisulfate, borate, butyrate, camphorate, camphorsulfonate, citrate, cyclopentanepropionate, digluconate, dodecylsulfate, ethanesulfonate, formate, fumarate, glucoheptonate, glycerophosphate, gluconate, hemisulfate, heptanoate, hexanoate, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, p-toluenesulfonate, undecanoate, valerate salts, and the like. Pharmaceutically acceptable salts derived from appropriate bases include alkali metal, alkaline earth metal, ammonium and N+(C1-4alkyl)4 salts. Representative alkali or alkaline earth metal salts include sodium, lithium, potassium, calcium, magnesium, and the like. Further pharmaceutically acceptable salts include, when appropriate, nontoxic ammonium, quaternary ammonium, and amine cations formed using counterions such as halide, hydroxide, carboxylate, sulfate, phosphate, nitrate, lower alkyl sulfonate, and aryl sulfonate.

In typical embodiments, the present invention is intended to encompass the compounds disclosed herein, and the pharmaceutically acceptable salts, pharmaceutically acceptable esters, tautomeric forms, polymorphs, and prodrugs of such compounds. In some embodiments, the present invention includes a pharmaceutically acceptable addition salt, a pharmaceutically acceptable ester, a solvate (e.g., hydrate) of an addition salt, a tautomeric form, a polymorph, an enantiomer, a mixture of enantiomers, a stereoisomer or mixture of stereoisomers (pure or as a racemic or non-racemic mixture) of a compound described herein.

Compounds described herein can comprise one or more asymmetric centers, and thus can exist in various isomeric forms, e.g., enantiomers and/or diastereomers. For example, the compounds described herein can be in the form of an individual enantiomer, diastereomer or geometric isomer, or can be in the form of a mixture of stereoisomers, including racemic mixtures and mixtures enriched in one or more stereoisomer. Isomers can be isolated from mixtures by methods known to those skilled in the art, including chiral high pressure liquid chromatography (HPLC) and the formation and crystallization of chiral salts; or preferred isomers can be prepared by asymmetric syntheses. See, for example, Jacques et al., Enantiomers, Racemates and Resolutions (Wiley Interscience, New York, 1981); Wilen et al., Tetrahedron 33:2725 (1977); Eliel, Stereochemistry of Carbon Compounds (McGraw-Hill, N Y, 1962); and Wilen, Tables of Resolving Agents and Optical Resolutions p. 268 (E.L. Eliel, Ed., Univ. of Notre Dame Press, Notre Dame, IN 1972). The invention additionally encompasses compounds described herein as individual isomers substantially free of other isomers, and alternatively, as mixtures of various isomers.

In certain embodiments the compounds and the transfer vehicles of which such compounds are a component (e.g., lipid nanoparticles) exhibit an enhanced (e.g., increased) ability to transfect one or more target cells. Accordingly, also provided herein are methods of transfecting one or more target cells. Such methods generally comprise the step of contacting the one or more target cells with the compounds and/or pharmaceutical compositions disclosed herein such that the one or more target cells are transfected with the circular RNA encapsulated therein. As used herein, the terms "transfect" or "transfection" refer to the intracellular introduction of one or more encapsulated materials (e.g., nucleic acids and/or polynucleotides) into a cell, or preferably into a target cell. The term "transfection efficiency" refers to the relative amount of such encapsulated material (e.g., polynucleotides) up-taken by, introduced into and/or expressed by the target cell which is subject to transfection. In some embodiments, transfection efficiency may be estimated by the amount of a reporter polynucleotide product produced by the target cells following transfection. In some embodiments, a transfer vehicle has high transfection efficiency. In some embodiments, a transfer vehicle has at least about 10%, 20%, 30%, 40%, 50%, 60%, 70%, 80%, or 90% transfection efficiency.

As used herein, the term "liposome" generally refers to a vesicle composed of lipids (e.g., amphiphilic lipids) arranged in one or more spherical bilayer or bilayers. Such liposomes may be unilamellar or multilamellar vesicles which have a membrane formed from a lipophilic material and an aqueous interior that contains the encapsulated circRNA to be delivered to one or more target cells, tissues and organs. In certain embodiments, the compositions described herein comprise one or more lipid nanoparticles. Examples of suitable lipids (e.g., ionizable lipids) that may be used to form the liposomes and lipid nanoparticles contemplated include one or more of the compounds disclosed herein (e.g., HGT4001, HGT4002, HGT4003, HGT4004 and/or HGT4005). Such liposomes and lipid nanoparticles may also comprise additional ionizable lipids such as C12-200, DLin-KC2-DMA, and/or HGT5001, helper lipids, structural lipids, PEG-modified lipids, MC3, DLinDMA, DLinkC2DMA, cKK-E12, ICE, HGT5000, DODAC, DDAB, DMRIE, DOSPA, DOGS, DODAP, DODMA, DMDMA, DODAC, DLenDMA, DMRIE, CLinDMA, CpLinDMA, DMOBA, DOcarbDAP, DLin-DAP, DLincarbDAP, DLinCDAP, KLin-K-DMA, DLin-K-XTC2-DMA, HGT4003, and combinations thereof.

As used herein, the phrase "biodegradable lipid" or "degradable lipid" refers to any of a number of lipid species that are broken down in a host environment on the order of minutes, hours, or days ideally making them less toxic and unlikely to accumulate in a host over time. Common modifications to lipids include ester bonds, and disulfide bonds among others to increase the biodegradability of a lipid.

As used herein, the phrase "biodegradable PEG lipid" or "degradable PEG lipid" refers to any of a number of lipid species where the PEG molecules are cleaved from the lipid in a host environment on the order of minutes, hours, or days ideally making them less immunogenic. Common modifications to PEG lipids include ester bonds, and disulfide bonds among others to increase the biodegradability of a lipid.

In certain embodiments of the present invention, the transfer vehicles (e.g., lipid nanoparticles) are prepared to encapsulate one or more materials or therapeutic agents (e.g., circRNA). The process of incorporating a desired therapeutic agent (e.g., circRNA) into a transfer vehicle is referred to herein as or "loading" or "encapsulating" (Lasic, et al., FEBS Lett., 312: 255-258, 1992). The transfer vehicle-loaded or -encapsulated materials (e.g., circRNA) may be completely or partially located in the interior space of the transfer vehicle, within a bilayer membrane of the transfer vehicle, or associated with the exterior surface of the transfer vehicle.

As used herein, the term "structural lipid" refers to sterols and also to lipids containing sterol moieties.

As defined herein, "sterols" are a subgroup of steroids consisting of steroid alcohols.

As used herein, the term "PEG" means any polyethylene glycol or other polyalkylene ether polymer.

As generally defined herein, a "PEG-OH lipid" (also referred to herein as "hydroxy-PEGylated lipid") is a PEGylated lipid having one or more hydroxyl (—OH) groups on the lipid.

As used herein, a "phospholipid" is a lipid that includes a phosphate moiety and one or more carbon chains, such as unsaturated fatty acid chains.

All nucleotide sequences disclosed herein can represent an RNA sequence or a corresponding DNA sequence. It is understood that deoxythymidine (dT or T) in a DNA is transcribed into a uridine (U) in an RNA. As such, "T" and "U" are used interchangeably herein in nucleotide sequences.

The recitations "sequence identity" or, for example, comprising a "sequence 50% identical to," as used herein, refer to the extent that sequences are identical on a nucleotide-by-nucleotide basis or an amino acid-by-amino acid basis over a window of comparison. Thus, a "percentage of sequence identity" may be calculated by comparing two optimally aligned sequences over the window of comparison, determining the number of positions at which the identical nucleic acid base (e.g., A, T, C, G, I) or the identical amino acid residue (e.g., Ala, Pro, Ser, Thr, Gly, Val, Leu, Ile, Phe, Tyr, Trp, Lys, Arg, His, Asp, Glu, Asn, Gln, Cys and Met) occurs in both sequences to yield the number of matched positions, dividing the number of matched positions by the total number of positions in the window of comparison (i.e., the window size), and multiplying the result by 100 to yield the percentage of sequence identity. Included are nucleotides and polypeptides having at least about 50%, 55%, 60%, 65%, 70%, 75%, 80%, 85%, 90%, 95%, 96%, 97%, 98%, 99% or 100% sequence identity to any of the reference sequences described herein, typically where the polypeptide variant maintains at least one biological activity of the reference polypeptide.

The expression sequences in the polynucleotide construct may be separated by a "cleavage site" sequence which enables polypeptides encoded by the expression sequences, once translated, to be expressed separately by the cell.

A "self-cleaving peptide" refers to a peptide which is translated without a peptide bond between two adjacent amino acids, or functions such that when the polypeptide comprising the proteins and the self-cleaving peptide is produced, it is immediately cleaved or separated into distinct and discrete first and second polypeptides without the need for any external cleavage activity.

The α and β chains of αβ TCR's are generally regarded as each having two domains or regions, namely variable and constant domains/regions. The variable domain consists of a concatenation of variable regions and joining regions. In the present specification and claims, the term "TCR alpha variable domain" therefore refers to the concatenation of TRAV and TRAJ regions, and the term TCR alpha constant domain refers to the extracellular TRAC region, or to a C-terminal truncated TRAC sequence. Likewise, the term "TCR beta variable domain" refers to the concatenation of TRBV and TRBD/TRBJ regions, and the term TCR beta constant domain refers to the extracellular TRBC region, or to a C-terminal truncated TRBC sequence.

As used herein, "autoimmunity" is defined as persistent and progressive immune reactions to non-infectious self-antigens, as distinct from infectious non self-antigens from bacterial, viral, fungal, or parasitic organisms which invade and persist within mammals and humans. Autoimmune conditions include scleroderma, Grave's disease, Crohn's disease, Sjorgen's disease, multiple sclerosis, Hashimoto's disease, psoriasis, myasthenia gravis, autoimmune polyendocrinopathy syndromes, Type I diabetes mellitus (TIDM), autoimmune gastritis, autoimmune uveoretinitis, polymyositis, colitis, and thyroiditis, as well as in the generalized autoimmune diseases typified by human Lupus. "Autoantigen" or "self-antigen" as used herein refers to an antigen or epitope which is native to the mammal and which is immunogenic in said mammal.

As used herein, the term "cationic lipid" or "ionizable lipid" refers to any of a number of lipid species that carry a net positive charge at a selected pH, such as physiological pH.

The term "antibody" (Ab) includes, without limitation, a glycoprotein immunoglobulin which binds specifically to an antigen. In general, an antibody may comprise at least two heavy (H) chains and two light (L) chains interconnected by disulfide bonds, or an antigen-binding molecule thereof. Each H chain may comprise a heavy chain variable region (abbreviated herein as VH) and a heavy chain constant region. The heavy chain constant region can comprise three constant domains, CH1, CH2 and CH3. Each light chain can comprise a light chain variable region (abbreviated herein as VL) and a light chain constant region. The light chain constant region can comprise one constant domain, CL. The VH and VL regions may be further subdivided into regions of hypervariability, termed complementarity determining regions (CDRs), interspersed with regions that are more conserved, termed framework regions (FR). Each VH and VL may comprise three CDRs and four FRs, arranged from amino-terminus to carboxy-terminus in the following order: FR1, CDR1, FR2, CDR2, FR3, CDR3, and FR4. The variable regions of the heavy and light chains contain a binding domain that interacts with an antigen. The constant regions of the Abs may mediate the binding of the immunoglobulin to host tissues or factors, including various cells of the immune system (e.g., effector cells) and the first component of the classical complement system. Antibodies may include, for example, monoclonal antibodies, recombinantly produced antibodies, monospecific antibodies, multispecific antibodies (including bispecific antibodies), human antibodies, engineered antibodies, humanized antibodies, chimeric antibodies, immunoglobulins, synthetic antibodies, tetrameric antibodies comprising two heavy chain and two light chain molecules, an antibody light chain monomer, an antibody heavy chain monomer, an antibody light chain dimer, an antibody heavy chain dimer, an antibody light chain-antibody heavy chain pair, intrabodies, antibody fusions (sometimes referred to herein as "antibody conjugates"), heteroconjugate antibodies, single domain antibodies, monovalent antibodies, single chain antibodies or single-chain variable fragments (scFv), camelized antibodies, affybodies, Fab fragments, F(ab')2 fragments, disulfide-linked variable fragments (sdFv), anti-idiotypic (anti-id) antibodies (including, e.g., anti-anti-Id antibodies), minibodies, domain antibodies, synthetic antibodies (sometimes referred to herein as "antibody mimetics"), and antigen-binding fragments of any of the above. In some embodiments, antibodies described herein refer to polyclonal antibody populations.

An immunoglobulin may derive from any of the commonly known isotypes, including but not limited to IgA, secretory IgA, IgG and IgM. IgG subclasses are also well known to those in the art and include but are not limited to human IgG1, IgG2, IgG3 and IgG4. "Isotype" refers to the Ab class or subclass (e.g., IgM or IgG1) that is encoded by the heavy chain constant region genes. The term "antibody" includes, by way of example, both naturally occurring and non-naturally occurring Abs; monoclonal and polyclonal Abs; chimeric and humanized Abs; human or nonhuman Abs; wholly synthetic Abs; and single chain Abs. A nonhuman Ab may be humanized by recombinant methods to reduce its immunogenicity in humans. Where not expressly stated, and unless the context indicates otherwise, the term "antibody" also includes an antigen-binding fragment or an antigen-binding portion of any of the aforementioned immunoglobulins, and includes a monovalent and a divalent fragment or portion, and a single chain Ab.

An "antigen binding molecule," "antigen binding portion," or "antibody fragment" refers to any molecule that comprises the antigen binding parts (e.g., CDRs) of the antibody from which the molecule is derived. An antigen binding molecule may include the antigenic complementarity determining regions (CDRs). Examples of antibody fragments include, but are not limited to, Fab, Fab', F(ab')2, Fv fragments, dAb, linear antibodies, scFv antibodies, and multispecific antibodies formed from antigen binding molecules. Peptibodies (i.e. Fc fusion molecules comprising peptide binding domains) are another example of suitable antigen binding molecules. In some embodiments, the antigen binding molecule binds to an antigen on a tumor cell. In some embodiments, the antigen binding molecule binds to an antigen on a cell involved in a hyperproliferative disease or to a viral or bacterial antigen. In some embodiments, the antigen binding molecule binds to BCMA. In further embodiments, the antigen binding molecule is an antibody fragment, including one or more of the complementarity determining regions (CDRs) thereof, that specifically binds to the antigen. In further embodiments, the antigen binding molecule is a single chain variable fragment (scFv). In some embodiments, the antigen binding molecule comprises or consists of avimers.

As used herein, the term "variable region" or "variable domain" is used interchangeably and are common in the art. The variable region typically refers to a portion of an antibody, generally, a portion of a light or heavy chain, typically about the amino-terminal 110 to 120 amino acids in the mature heavy chain and about 90 to 115 amino acids in the mature light chain, which differ extensively in sequence among antibodies and are used in the binding and specificity of a particular antibody for its particular antigen. The variability in sequence is concentrated in those regions called complementarity determining regions (CDRs) while the more highly conserved regions in the variable domain are called framework regions (FR). Without wishing to be bound by any particular mechanism or theory, it is believed that the CDRs of the light and heavy chains are primarily responsible for the interaction and specificity of the antibody with antigen. In some embodiments, the variable region is a human variable region. In some embodiments, the variable region comprises rodent or murine CDRs and human framework regions (FRs). In particular embodiments, the variable region is a primate (e.g., non-human primate) variable region. In some embodiments, the variable region comprises rodent or murine CDRs and primate (e.g., non-human primate) framework regions (FRs).

The terms "VL" and "VL domain" are used interchangeably to refer to the light chain variable region of an antibody or an antigen-binding molecule thereof.

The terms "VH" and "VH domain" are used interchangeably to refer to the heavy chain variable region of an antibody or an antigen-binding molecule thereof.

A number of definitions of the CDRs are commonly in use: Kabat numbering, Chothia numbering, AbM numbering, or contact numbering. The AbM definition is a compromise between the two used by Oxford Molecular's AbM antibody modelling software. The contact definition is based on an analysis of the available complex crystal structures. The term "Kabat numbering" and like terms are recognized in the art and refer to a system of numbering amino acid residues in the heavy and light chain variable regions of an antibody, or an antigen-binding molecule thereof. In certain aspects, the CDRs of an antibody may be determined according to the Kabat numbering system (see, e.g., Kabat E A & Wu T T (1971) Ann NY Acad Sci 190: 382-391 and Kabat E A et al., (1991) Sequences of Proteins of Immunological Interest, Fifth Edition, U.S. Department of Health and Human Services, NIH Publication No. 91-3242). Using the Kabat numbering system, CDRs within an antibody heavy chain molecule are typically present at amino acid positions 31 to 35, which optionally may include one or two additional amino acids, following 35 (referred to in the Kabat numbering scheme as 35A and 35B) (CDR1), amino acid positions 50 to 65 (CDR2), and amino acid positions 95 to 102 (CDR3). Using the Kabat numbering system, CDRs within an antibody light chain molecule are typically present at amino acid positions 24 to 34 (CDR1), amino acid positions 50 to 56 (CDR2), and amino acid positions 89 to 97 (CDR3). In a specific embodiment, the CDRs of the antibodies described herein have been determined according to the Kabat numbering scheme. In certain aspects, the CDRs of an antibody may be determined according to the Chothia numbering scheme, which refers to the location of immunoglobulin structural loops (see, e.g., Chothia C & Lesk A M, (1987), J Mol Biol 196: 901-917; Al-Lazikani B et al, (1997) J Mol Biol 273: 927-948; Chothia C et al., (1992) J Mol Biol 227: 799-817; Tramontano A et al, (1990) J Mol Biol 215(1): 175-82; and U.S. Pat. No. 7,709,226). Typically, when using the Kabat numbering convention, the Chothia CDR-H1 loop is present at heavy chain amino acids 26 to 32, 33, or 34, the Chothia CDR-H2 loop is present at heavy chain amino acids 52 to 56, and the Chothia CDR-H3 loop is present at heavy chain amino acids 95 to 102, while the Chothia CDR-L1 loop is present at light chain amino acids 24 to 34, the Chothia CDR-L2 loop is present at light chain amino acids 50 to 56, and the Chothia CDR-L3 loop is present at light chain amino acids 89 to 97. The end of the Chothia CDR-HI loop when numbered using the Kabat numbering convention varies between H32 and H34 depending on the length of the loop (this is because the Kabat numbering scheme places the insertions at H35A and H35B; if neither 35A nor 35B is present, the loop ends at 32; if only 35A is present, the loop ends at 33; if both 35A and 35B are present, the loop ends at 34). In a specific embodiment, the CDRs of the antibodies described herein have been determined according to the Chothia numbering scheme.

As used herein, the terms "constant region" and "constant domain" are interchangeable and have a meaning common in the art. The constant region is an antibody portion, e.g., a carboxyl terminal portion of a light and/or heavy chain which is not directly involved in binding of an antibody to antigen but which may exhibit various effector functions, such as interaction with the Fc receptor. The constant region of an immunoglobulin molecule generally has a more conserved amino acid sequence relative to an immunoglobulin variable domain.

"Binding affinity" generally refers to the strength of the sum total of non-covalent interactions between a single binding site of a molecule (e.g., an antibody) and its binding partner (e.g., an antigen). Unless indicated otherwise, as used herein, "binding affinity" refers to intrinsic binding affinity which reflects a 1:1 interaction between members of a binding pair (e.g., antibody and antigen). The affinity of a molecule X for its partner Y may generally be represented by the dissociation constant (KD or Kd). Affinity may be measured and/or expressed in a number of ways known in the art, including, but not limited to, equilibrium dissociation constant (KD), and equilibrium association constant (KA or Ka). The KD is calculated from the quotient of koff/kon, whereas KA is calculated from the quotient of kon/koff. kon refers to the association rate constant of, e.g., an antibody to an antigen, and koff refers to the dissociation of, e.g., an antibody to an antigen. The kon and koff may be determined by techniques known to one of ordinary skill in the art, such as BIACORE® or KinExA.

As used herein, a "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine, tryptophan), nonpolar side chains (e.g., alanine, valine, leucine, isoleucine, proline, phenylalanine, methionine), beta-branched side chains (e.g., threonine, valine, isoleucine) and aromatic side chains (e.g., tyrosine, phenylalanine, tryptophan, histidine). In some embodiments, one or more amino acid residues within a CDR(s) or within a framework region(s) of an antibody or antigen-binding molecule thereof may be replaced with an amino acid residue with a similar side chain.

As, used herein, the term "heterologous" means from any source other than naturally occurring sequences.

As used herein, an "epitope" is a term in the art and refers to a localized region of an antigen to which an antibody may specifically bind. An epitope may be, for example, contiguous amino acids of a polypeptide (linear or contiguous epitope) or an epitope can, for example, come together from two or more non-contiguous regions of a polypeptide or polypeptides (conformational, non-linear, discontinuous, or non-contiguous epitope). In some embodiments, the epitope to which an antibody binds may be determined by, e.g., NMR spectroscopy, X-ray diffraction crystallography studies, ELISA assays, hydrogen/deuterium exchange coupled with mass spectrometry (e.g., liquid chromatography electrospray mass spectrometry), array-based oligo-peptide scanning assays, and/or mutagenesis mapping (e.g., site-directed mutagenesis mapping). For X-ray crystallography, crystallization may be accomplished using any of the known methods in the art (e.g., Giege R et al., (1994) Acta Crystallogr D Biol Crystallogr 50 (Pt 4): 339-350; McPherson A (1990) Eur J Biochem 189: 1-23; Chayen N E (1997) Structure 5: 1269-1274; McPherson A (1976) J Biol Chem 251: 6300-6303). Antibody: antigen crystals may be studied using well known X-ray diffraction techniques and may be refined using computer software such as X-PLOR (Yale University, 1992, distributed by Molecular Simulations, Inc.; see e.g. Meth Enzymol (1985) volumes 114 & 115, eds Wyckoff H W et al.; U.S. Patent Publication No. 2004/0014194), and BUSTER (Bricogne G (1993) Acta Crystallogr D Biol Crystallogr 49 (Pt 1): 37-60; Bricogne G (1997) Meth Enzymol 276A: 361-423, ed Carter C W; Roversi P et al., (2000) Acta Crystallogr D Biol Crystallogr 56 (Pt 10): 1316-1323).

As used herein, an antigen binding molecule, an antibody, or an antigen binding molecule thereof "cross-competes" with a reference antibody or an antigen binding molecule thereof if the interaction between an antigen and the first binding molecule, an antibody, or an antigen binding molecule thereof blocks, limits, inhibits, or otherwise reduces the ability of the reference binding molecule, reference antibody, or an antigen binding molecule thereof to interact with the antigen. Cross competition may be complete, e.g., binding of the binding molecule to the antigen completely blocks the ability of the reference binding molecule to bind the antigen, or it may be partial, e.g., binding of the binding molecule to the antigen reduces the ability of the reference binding molecule to bind the antigen. In some embodiments, an antigen binding molecule that cross-competes with a reference antigen binding molecule binds the same or an overlapping epitope as the reference antigen binding molecule. In other embodiments, the antigen binding molecule that cross-competes with a reference antigen binding molecule binds a different epitope as the reference antigen binding molecule. Numerous types of competitive binding assays may be used to determine if one antigen binding molecule competes with another, for example: solid phase direct or indirect radioimmunoassay (RIA); solid phase direct or indirect enzyme immunoassay (EIA); sandwich competition assay (Stahli et al., 1983, Methods in Enzymology 9:242-253); solid phase direct biotin-avidin EIA (Kirkland et al., 1986, J. Immunol. 137:3614-3619); solid phase direct labeled assay, solid phase direct labeled sandwich assay (Harlow and Lane, 1988, Antibodies, A Laboratory Manual, Cold Spring Harbor Press); solid phase direct label RIA using 1-125 label (Morel et al., 1988, Molec. Immunol. 25:7-15); solid phase direct biotin-avidin EIA (Cheung, et al., 1990, Virology 176:546-552); and direct labeled RIA (Moldenhauer et al., 1990, Scand. J. Immunol. 32:77-82).

As used herein, the terms "immunospecifically binds," "immunospecifically recognizes," "specifically binds," and "specifically recognizes" are analogous terms in the context of antibodies and refer to molecules that bind to an antigen (e.g., epitope or immune complex) as such binding is understood by one skilled in the art. For example, a molecule that specifically binds to an antigen may bind to other peptides or polypeptides, generally with lower affinity as determined by, e.g., immunoassays, BIACORE®, KinExA 3000 instrument (Sapidyne Instruments, Boise, ID), or other assays known in the art. In a specific embodiment, molecules that specifically bind to an antigen bind to the antigen with a KA that is at least 2 logs, 2.5 logs, 3 logs, 4 logs or greater than the KA when the molecules bind to another antigen.

An "antigen" refers to any molecule that provokes an immune response or is capable of being bound by an antibody or an antigen binding molecule. The immune response may involve either antibody production, or the activation of specific immunologically-competent cells, or both. A person of skill in the art would readily understand that any macromolecule, including virtually all proteins or peptides, may serve as an antigen. An antigen may be endogenously expressed, i.e. expressed by genomic DNA, or may be recombinantly expressed. An antigen may be specific to a certain tissue, such as a cancer cell, or it may be broadly expressed. In addition, fragments of larger molecules may act as antigens. In some embodiments, antigens are tumor antigens.

The term "autologous" refers to any material derived from the same individual to which it is later to be re-introduced. For example, the engineered autologous cell therapy (eACT™) method described herein involves collection of lymphocytes from a patient, which are then engineered to express, e.g., a CAR construct, and then administered back to the same patient.

The term "allogeneic" refers to any material derived from one individual which is then introduced to another individual of the same species, e.g., allogeneic T cell transplantation.

A "cancer" refers to a broad group of various diseases characterized by the uncontrolled growth of abnormal cells in the body. Unregulated cell division and growth results in the formation of malignant tumors that invade neighboring tissues and may also metastasize to distant parts of the body through the lymphatic system or bloodstream. A "cancer" or "cancer tissue" may include a tumor. Examples of cancers that may be treated by the methods disclosed herein include, but are not limited to, cancers of the immune system including lymphoma, leukemia, myeloma, and other leukocyte malignancies. In some embodiments, the methods disclosed herein may be used to reduce the tumor size of a tumor derived from, for example, bone cancer, pancreatic cancer, skin cancer, cancer of the head or neck, cutaneous or intraocular malignant melanoma, uterine cancer, ovarian cancer, rectal cancer, cancer of the anal region, stomach cancer, testicular cancer, uterine cancer, multiple myeloma, Hodgkin's Disease, non-Hodgkin's lymphoma (NHL), primary mediastinal large B cell lymphoma (PMBC), diffuse large B cell lymphoma (DLBCL), follicular lymphoma (FL), transformed follicular lymphoma, splenic marginal zone lymphoma (SMZL), cancer of the esophagus, cancer of the small intestine, cancer of the endocrine system, cancer of the thyroid gland, cancer of the parathyroid gland, cancer of the adrenal gland, cancer of the urethra, cancer of the penis, chronic or acute leukemia, acute myeloid leukemia, chronic myeloid leukemia, acute lymphoblastic leukemia (ALL) (including non T cell ALL), chronic lymphocytic leukemia (CLL), solid tumors of childhood, lymphocytic lymphoma, cancer of the bladder, cancer of the kidney or ureter, neoplasm of the central nervous system (CNS), primary CNS lymphoma, tumor angiogenesis, spinal axis tumor, brain stem glioma, pituitary adenoma, epidermoid cancer, squamous cell cancer, T cell lymphoma, environmentally induced cancers including those induced by asbestos, other B cell malignancies, and combinations of said cancers. In some embodiments, the methods disclosed herein may be used to reduce the tumor size of a tumor derived from, for example, sarcomas and carcinomas, fibrosarcoma, myxosarcoma, liposarcoma, chondrosarcoma, osteogenic sarcoma, Kaposi's sarcoma, sarcoma of soft tissue, and other sarcomas, synovioma, mesothelioma, Ewing's tumor, leiomyosarcoma, rhabdomyosarcoma, colon carcinoma, pancreatic cancer, breast cancer, ovarian cancer, prostate cancer, hepatocellular carcinomna, lung cancer, colorectal cancer, squamous cell carcinoma, basal cell carcinoma, adenocarcinoma (for example adenocarcinoma of the pancreas, colon, ovary, lung, breast, stomach, prostate, cervix, or esophagus), sweat gland carcinoma, sebaceous gland carcinoma, papillary carcinoma, papillary adenocarcinomas, medullary carcinoma, bronchogenic carcinoma, renal cell carcinoma, hepatoma, bile duct carcinoma, choriocarcinoma, Wilms' tumor, cervical cancer, testicular tumor, bladder carcinoma, carcinoma of the fallopian tubes, carcinoma of the endometrium, carcinoma of the cervix, carcinoma of the vagina, carcinoma of the vulva, carcinoma of the renal pelvis, CNS tumors (such as a glioma, astrocytoma, medulloblastoma, craniopharyogioma, ependymoma, pinealoma, hemangioblastoma, acoustic neuroma, oligodendroglioma, menangioma, melanoma, neuroblastoma and retinoblastoma). The particular cancer may be responsive to chemo- or radiation therapy or the cancer may be refractory. A refractory cancer refers to a cancer that is not amenable to surgical intervention and the cancer is either initially unresponsive to chemo- or radiation therapy or the cancer becomes unresponsive over time.

An "anti-tumor effect" as used herein, refers to a biological effect that may present as a decrease in tumor volume, a decrease in the number of tumor cells, a decrease in tumor cell proliferation, a decrease in the number of metastases, an increase in overall or progression-free survival, an increase in life expectancy, or amelioration of various physiological symptoms associated with the tumor. An anti-tumor effect may also refer to the prevention of the occurrence of a tumor, e.g., a vaccine.

A "cytokine," as used herein, refers to a non-antibody protein that is released by one cell in response to contact with a specific antigen, wherein the cytokine interacts with a second cell to mediate a response in the second cell. "Cytokine" as used herein is meant to refer to proteins released by one cell population that act on another cell as intercellular mediators. A cytokine may be endogenously expressed by a cell or administered to a subject. Cytokines may be released by immune cells, including macrophages, B cells, T cells, neutrophils, dendritic cells, eosinophils and mast cells to propagate an immune response. Cytokines may induce various responses in the recipient cell. Cytokines may include homeostatic cytokines, chemokines, pro-inflammatory cytokines, effectors, and acute-phase proteins. For example, homeostatic cytokines, including interleukin (IL) 7 and IL-15, promote immune cell survival and proliferation, and pro-inflammatory cytokines may promote an inflammatory response. Examples of homeostatic cytokines include, but are not limited to, IL-2, IL-4, IL-5, IL-7, IL-10, IL-12p40, IL-12p70, IL-15, and interferon (IFN) gamma. Examples of pro-inflammatory cytokines include, but are not limited to, IL-1a, IL-1b, IL-6, IL-13, IL-17a, IL-23, IL-27, tumor necrosis factor (TNF)-alpha, TNF-beta, fibroblast growth factor (FGF) 2, granulocyte macrophage colony-stimulating factor (GM-CSF), soluble intercellular adhesion molecule 1 (sICAM-1), soluble vascular adhesion molecule 1 (sVCAM-1), vascular endothelial growth factor (VEGF), VEGF-C, VEGF-D, and placental growth factor (PLGF). Examples of effectors include, but are not limited to, granzyme A, granzyme B, soluble Fas ligand (sFasL), TGF-beta, IL-35, and perforin. Examples of acute phase-proteins include, but are not limited to, C-reactive protein (CRP) and serum amyloid A (SAA).

The term "lymphocyte" as used herein includes natural killer (NK) cells, T cells, or B cells. NK cells are a type of cytotoxic (cell toxic) lymphocyte that represent a major component of the innate immune system. NK cells reject tumors and cells infected by viruses. It works through the process of apoptosis or programmed cell death. They were termed "natural killers" because they do not require activation in order to kill cells. T cells play a major role in cell-mediated-immunity (no antibody involvement). T cell receptors (TCR) differentiate T cells from other lymphocyte types. The thymus, a specialized organ of the immune system, is the primary site for T cell maturation. There are numerous types of T cells, including: helper T cells (e.g., CD4+ cells), cytotoxic T cells (also known as TC, cytotoxic T lymphocytes, CTL, T-killer cells, cytolytic T cells, CD8+ T cells or killer T cells), memory T cells ((i) stem memory cells (TSCM), like naive cells, are CD45RO−, CCR7+, CD45RA+, CD62L+(L-selectin), CD27+, CD28+ and IL-7Ra+, but also express large amounts of CD95, IL-2R, CXCR3, and LFA-1, and show numerous functional attributes distinctive of memory cells); (ii) central memory cells (TCM) express L-selectin and CCR7, they secrete IL-2, but not IFNγ or IL-4, and (iii) effector memory cells (TEM), however, do not express L-selectin or CCR7 but produce effector cytokines like IFNγ and IL-4), regulatory T cells (Tregs, suppressor T cells, or CD4+CD25+ or CD4+FoxP3+ regulatory T cells), natural killer T cells (NKT) and gamma delta T cells. B-cells, on the other hand, play a principal role in humoral immunity (with antibody involvement). B-cells make antibodies, are capable of acting as antigen-presenting cells (APCs) and turn into memory B-cells and plasma cells, both short-lived and long-lived, after activation by antigen interaction. In mammals, immature B-cells are formed in the bone marrow.

The term "genetically engineered" or "engineered" refers to a method of modifying the genome of a cell, including, but not limited to, deleting a coding or non-coding region or a portion thereof or inserting a coding region or a portion thereof. In some embodiments, the cell that is modified is a lymphocyte, e.g., a T cell, which may either be obtained from a patient or a donor. The cell may be modified to express an exogenous construct, such as, e.g., a chimeric antigen receptor (CAR) or a T cell receptor (TCR), which is incorporated into the cell's genome.

An "immune response" refers to the action of a cell of the immune system (for example, T lymphocytes, B lymphocytes, natural killer (NK) cells, macrophages, eosinophils, mast cells, dendritic cells and neutrophils) and soluble macromolecules produced by any of these cells or the liver (including Abs, cytokines, and complement) that results in selective targeting, binding to, damage to, destruction of, and/or elimination from a vertebrate's body of invading pathogens, cells or tissues infected with pathogens, cancerous or other abnormal cells, or, in cases of autoimmunity or pathological inflammation, normal human cells or tissues.

A "costimulatory signal," as used herein, refers to a signal, which in combination with a primary signal, such as TCR/CD3 ligation, leads to a T cell response, such as, but not limited to, proliferation and/or upregulation or down regulation of key molecules.

A "costimulatory ligand," as used herein, includes a molecule on an antigen presenting cell that specifically binds a cognate co-stimulatory molecule on a T cell. Binding of the costimulatory ligand provides a signal that mediates a T cell response, including, but not limited to, proliferation, activation, differentiation, and the like. A costimulatory ligand induces a signal that is in addition to the primary signal provided by a stimulatory molecule, for instance, by binding of a T cell receptor (TCR)/CD3 complex with a major histocompatibility complex (MHC) molecule loaded with peptide. A co-stimulatory ligand may include, but is not limited to, 3/TR6, 4-IBB ligand, agonist or antibody that binds Toll-like receptor, B7-1 (CD80), B7-2 (CD86), CD30 ligand, CD40, CD7, CD70, CD83, herpes virus entry mediator (HVEM), human leukocyte antigen G (HLA-G), ILT4, immunoglobulin-like transcript (ILT) 3, inducible costimulatory ligand (ICOS-L), intercellular adhesion molecule (ICAM), ligand that specifically binds with B7-H3, lymphotoxin beta receptor, MHC class I chain-related protein A (MICA), MHC class I chain-related protein B (MICB), OX40 ligand, PD-L2, or programmed death (PD) LI. A co-stimulatory ligand includes, without limitation, an antibody that specifically binds with a co-stimulatory molecule present on a T cell, such as, but not limited to, 4-1BB, B7-H3, CD2, CD27, CD28, CD30, CD40, CD7, ICOS, ligand that specifically binds with CD83, lymphocyte function-associated antigen-1 (LFA-1), natural killer cell receptor C (NKG2C), OX40, PD-1, or tumor necrosis factor superfamily member 14 (TNFSF14 or LIGHT).

A "costimulatory molecule" is a cognate binding partner on a T cell that specifically binds with a costimulatory ligand, thereby mediating a costimulatory response by the T cell, such as, but not limited to, proliferation. Costimulatory molecules include, but are not limited to, 4-1BB/CD137, B7-H3, BAFFR, BLAME (SLAMF8), BTLA, CD 33, CD 45, CD100 (SEMA4D), CD103, CD134, CD137, CD154, CD16, CD160 (BY55), CD 18, CD19, CD19a, CD2, CD22, CD247, CD27, CD276 (B7-H3), CD28, CD29, CD3 (alpha; beta; delta; epsilon; gamma; zeta), CD30, CD37, CD4, CD4, CD40, CD49a, CD49D, CD49f, CD5, CD64, CD69, CD7, CD80, CD83 ligand, CD84, CD86, CD8alpha, CD8beta, CD9, CD96 (Tactile), CD1-1a, CD1-1b, CD1-1c, CD1-1d, CDS, CEACAM1, CRT AM, DAP-10, DNAM1 (CD226), Fc gamma receptor, GADS, GITR, HVEM (LIGHTR), IA4, ICAM-1, ICAM-1, ICOS, Ig alpha (CD79a), IL2R beta, IL2R gamma, IL7R alpha, integrin, ITGA4, ITGA4, ITGA6, IT GAD, ITGAE, ITGAL, ITGAM, ITGAX, ITGB2, ITGB7, ITGB1, KIRDS2, LAT, LFA-1, LFA-1, LIGHT, LIGHT (tumor necrosis factor superfamily member 14; TNFSF14), LTBR, Ly9 (CD229), lymphocyte function-associated antigen-1 (LFA-1 (CD11a/CD18), MHC class I molecule, NKG2C, NKG2D, NKp30, NKp44, NKp46, NKp80 (KLRF1), OX40, PAG/Cbp, PD-1, PSGL1, SELPLG (CD162), signaling lymphocytic activation molecule, SLAM (SLAMF1; CD150; IPO-3), SLAMF4 (CD244; 2B4), SLAMF6 (NTB-A; Lyl08), SLAMF7, SLP-76, TNF, TNFr, TNFR2, Toll ligand receptor, TRANCE/RANKL, VLA1, or VLA-6, or fragments, truncations, or combinations thereof.

As used herein, a "vaccine" refers to a composition for generating immunity for the prophylaxis and/or treatment of diseases. Accordingly, vaccines are medicaments which comprise antigens and are intended to be used in humans or animals for generating specific defense and protective substances upon administration to the human or animal.

As used herein, a "neoantigen" refers to a class of tumor antigens which arises from tumor-specific mutations in an expressed protein.

As used herein, a "fusion protein" is a protein with at least two domains that are encoded by separate genes that have been joined to transcribe for a single peptide.

2. DNA Template, Precusor RNA & Circular RNA

According to the present invention, transcription of a DNA template provided herein (e.g., comprising a 3' enhanced intron element, 3' enhanced exon element, a core functional element, a 5' enhanced exon element, and a 5' enhanced intron element) results in formation of a precursor linear RNA polynucleotide capable of circularizing. In some embodiments, this DNA template comprises a vector, PCR product, plasmid, minicircle DNA, cosmid, artificial chromosome, complementary DNA (cDNA), extrachromosomal DNA (ecDNA), or a fragment therein. In certain embodiments, the minicircle DNA may be linearized or non-linearized. In certain embodiments, the plasmid may be linearized or non-linearized. In some embodiments, the DNA template may be single-stranded. In other embodiments, the DNA template may be double-stranded. In some embodiments, the DNA template comprises in whole or in part from a viral, bacterial or eukaryotic vector.

The present invention, as provided herein, comprises a DNA template that shares the same sequence as the precursor linear RNA polynucleotide prior to splicing of the precursor linear RNA polynucleotide (e.g., a 3' enhanced intron element, a 3' enhanced exon element, a core functional element, and a 5' enhanced exon element, a 5' enhanced intron element). In some embodiments, said linear precursor RNA polynucleotide undergoes splicing leading to the removal of the 3' enhanced intron element and 5' enhanced intron element during the process of circularization. In some embodiments, the resulting circular RNA polynucleotide lacks a 3' enhanced intron fragment and a 5' enhanced intron fragment, but maintains a 3' enhanced exon fragment, a core functional element, and a 5' enhanced exon element.

In some embodiments, the precursor linear RNA polynucleotide circularizes when incubated in the presence of one or more guanosine nucleotides or nucleoside (e.g., GTP) and a divalent cation (e.g., $Mg^{2+}$). In some embodiments, the 3' enhanced exon element, 5' enhanced exon element, and/or core functional element in whole or in part promotes the circularization of the precursor linear RNA polynucleotide to form the circular RNA polynucleotide provided herein.

In certain embodiments circular RNA provided herein is produced inside a cell. In some embodiments, precursor RNA is transcribed using a DNA template (e.g., in some embodiments, using a vector provided herein) in the cytoplasm by a bacteriophage RNA polymerase, or in the nucleus by host RNA polymerase II and then circularized.

In certain embodiments, the circular RNA provided herein is injected into an animal (e.g., a human), such that a polypeptide encoded by the circular RNA molecule is expressed inside the animal.

In some embodiments, the DNA (e.g., vector), linear RNA (e.g., precursor RNA), and/or circular RNA polynucleotide provided herein is between 300 and 10000, 400 and 9000, 500 and 8000, 600 and 7000, 700 and 6000, 800 and 5000, 900 and 5000, 1000 and 5000, 1100 and 5000, 1200 and 5000, 1300 and 5000, 1400 and 5000, and/or 1500 and 5000 nucleotides in length. In some embodiments, the polynucleotide is at least 300 nt, 400 nt, 500 nt, 600 nt, 700 nt, 800 nt, 900 nt, 1000 nt, 1100 nt, 1200 nt, 1300 nt, 1400 nt, 1500 nt, 2000 nt, 2500 nt, 3000 nt, 3500 nt, 4000 nt, 4500 nt, or 5000 nt in length. In some embodiments, the polynucleotide is no more than 3000 nt, 3500 nt, 4000 nt, 4500 nt, 5000 nt, 6000 nt, 7000 nt, 8000 nt, 9000 nt, or 10000 nt in length. In some embodiments, the length of a DNA, linear RNA, and/or circular RNA polynucleotide provided herein is about 300 nt, 400 nt, 500 nt, 600 nt, 700 nt, 800 nt, 900 nt, 1000 nt, 1100 nt, 1200 nt, 1300 nt, 1400 nt, 1500 nt, 2000 nt, 2500 nt, 3000 nt, 3500 nt, 4000 nt, 4500 nt, 5000 nt, 6000 nt, 7000 nt, 8000 nt, 9000 nt, or 10000 nt.

In some embodiments, the circular RNA provided herein has higher functional stability than mRNA comprising the same expression sequence. In some embodiments, the circular RNA provided herein has higher functional stability than mRNA comprising the same expression sequence, 5moU modifications, an optimized UTR, a cap, and/or a polyA tail.

In some embodiments, the circular RNA polynucleotide provided herein has a functional half-life of at least 5 hours, 10 hours, 15 hours, 20 hours. 30 hours, 40 hours, 50 hours, 60 hours, 70 hours or 80 hours. In some embodiments, the circular RNA polynucleotide provided herein has a functional half-life of 5-80, 10-70, 15-60, and/or 20-50 hours. In some embodiments, the circular RNA polynucleotide provided herein has a functional half-life greater than (e.g., at least 1.5-fold greater than, at least 2-fold greater than) that of an equivalent linear RNA polynucleotide encoding the same protein. In some embodiments, functional half-life can be assessed through the detection of functional protein synthesis.

In some embodiments, the circular RNA polynucleotide provided herein has a half-life of at least 5 hours, 10 hours, 15 hours, 20 hours. 30 hours, 40 hours, 50 hours, 60 hours, 70 hours or 80 hours. In some embodiments, the circular RNA polynucleotide provided herein has a half-life of 5-80, 10-70, 15-60, and/or 20-50 hours. In some embodiments, the circular RNA polynucleotide provided herein has a half-life greater than (e.g., at least 1.5-fold greater than, at least 2-fold greater than) that of an equivalent linear RNA polynucleotide encoding the same protein. In some embodiments, the circular RNA polynucleotide, or pharmaceutical composition thereof, has a functional half-life in a human cell greater than or equal to that of a pre-determined threshold value. In some embodiments the functional half-life is determined by a functional protein assay. For example in some embodiments, the functional half-life is determined by an in vitro luciferase assay, wherein the activity of *Gaussia* luciferase (GLuc) is measured in the media of human cells (e.g. HepG2) expressing the circular RNA polynucleotide every 1, 2, 6, 12, or 24 hours over 1, 2, 3, 4, 5, 6, 7, or 14 days. In other embodiments, the functional half-life is determined by an in vivo assay, wherein levels of a protein encoded by the expression sequence of the circular RNA polynucleotide are measured in patient serum or tissue samples every 1, 2, 6, 12, or 24 hours over 1, 2, 3, 4, 5, 6, 7, or 14 days. In some embodiments, the pre-determined threshold value is the functional half-life of a reference linear RNA polynucleotide comprising the same expression sequence as the circular RNA polynucleotide.

In some embodiments, the circular RNA provided herein may have a higher magnitude of expression than equivalent linear mRNA, e.g., a higher magnitude of expression 24 hours after administration of RNA to cells. In some embodiments, the circular RNA provided herein has a higher magnitude of expression than mRNA comprising the same expression sequence, 5moU modifications, an optimized UTR, a cap, and/or a polyA tail.

In some embodiments, the circular RNA provided herein may be less immunogenic than an equivalent mRNA when exposed to an immune system of an organism or a certain type of immune cell. In some embodiments, the circular RNA provided herein is associated with modulated production of cytokines when exposed to an immune system of an organism or a certain type of immune cell. For example, in some embodiments, the circular RNA provided herein is associated with reduced production of IFN-β1, RIG-I, IL-2, IL-6, IFNγ, and/or TNFα when exposed to an immune system of an organism or a certain type of immune cell as compared to mRNA comprising the same expression sequence. In some embodiments, the circular RNA provided herein is associated with less IFN-β1, RIG-I, IL-2, IL-6, IFNγ, and/or TNFα transcript induction when exposed to an immune system of an organism or a certain type of immune cell as compared to mRNA comprising the same expression sequence. In some embodiments, the circular RNA provided herein is less immunogenic than mRNA comprising the same expression sequence. In some embodiments, the circular RNA provided herein is less immunogenic than mRNA comprising the same expression sequence, 5moU modifications, an optimized UTR, a cap, and/or a polyA tail.

In certain embodiments, the circular RNA provided herein can be transfected into a cell as is, or can be transfected in DNA vector form and transcribed in the cell. Transcription of circular RNA from a transfected DNA vector can be via added polymerases or polymerases encoded by nucleic acids transfected into the cell, or preferably via endogenous polymerases.

A. Enhanced Intron Elements & Enhanced Exon Elements

As present in the invention herein, the enhanced intron elements and enhanced exon elements may comprise spacers, duplex regions, affinity sequences, intron fragments, exon fragments and various untranslated elements. These sequences within the enhanced intron elements or enhanced exon elements are arranged to optimize circularization or protein expression.

In certain embodiments, the DNA template, precursor linear RNA polynucleotide and circular RNA provided herein comprise a first (5') and/or a second (3') spacer. In some embodiments, the DNA template or precursor linear RNA polynucleotide comprises one or more spacers. In some embodiments, the DNA template, precursor linear RNA polynucleotide comprises one or more spacers in the enhanced intron elements. In some embodiments, the DNA template, precursor linear RNA polynucleotide comprises one or more spacers in the enhanced exon elements. In certain embodiments, the DNA template or linear RNA polynucleotide comprises a spacer in the 3' enhanced intron fragment and a spacer in the 5' enhanced intron fragment. In certain embodiments, DNA template, precursor linear RNA polynucleotide, or circular RNA comprises a spacer in the 3' enhanced exon fragment and another spacer in the 5' enhanced exon fragment to aid with circularization or protein expression due to symmetry created in the overall sequence.

In some embodiments, including a spacer between the 3' group I intron fragment and the core functional element may conserve secondary structures in those regions by preventing them from interacting, thus increasing splicing efficiency. In some embodiments, the first (between 3' group I intron fragment and core functional element) and second (between the two expression sequences and core functional element) spacers comprise additional base pairing regions that are predicted to base pair with each other and not to the first and second duplex regions. In other embodiments, the first (between 3' group I intron fragment and core functional element) and second (between the one of the core functional element and 5' group I intron fragment) spacers comprise additional base pairing regions that are predicted to base pair with each other and not to the first and second duplex regions. In some embodiments, such spacer base pairing brings the group I intron fragments in close proximity to each other, further increasing splicing efficiency. Additionally, in some embodiments, the combination of base pairing between the first and second duplex regions, and separately, base pairing between the first and second spacers, promotes the formation of a splicing bubble containing the group I intron fragments flanked by adjacent regions of base pairing. Typical spacers are contiguous sequences with one or more of the following qualities: 1) predicted to avoid interfering with proximal structures, for example, the IRES, expression sequence, aptamer, or intron; 2) is at least 7 nt long and no longer than 100 nt; 3) is located after and adjacent to the 3' intron fragment and/or before and adjacent to the 5' intron fragment; and 4) contains one or more of the following: a) an unstructured region at least 5 nt long, b) a region of base pairing at least 5 nt long to a distal sequence, including another spacer, and c) a structured region at least 7 nt long limited in scope to the sequence of the spacer. Spacers may have several regions, including an unstructured region, a base pairing region, a hairpin/structured region, and combinations thereof. In an embodiment, the spacer has a structured region with high GC content. In an embodiment, a region within a spacer base pairs with another region within the same spacer. In an embodiment, a region within a spacer base pairs with a region within another spacer. In an embodiment, a spacer comprises one or more hairpin structures. In an embodiment, a spacer comprises one or more hairpin structures with a stem of 4 to 12 nucleotides and a loop of 2 to 10 nucleotides. In an embodiment, there is an additional spacer between the 3' group I intron fragment and the core functional element. In an embodiment, this additional spacer prevents the structured regions of the IRES or aptamer of a TIE from interfering with the folding of the 3' group I intron fragment or reduces the extent to which this occurs. In some embodiments, the 5' spacer sequence is at least 7, 8, 9, 10, 11, 12, 13, 14, 15, 16, 17, 18, 19, 20, 25 or 30 nucleotides in length. In some embodiments, the 5' spacer sequence is no more than 100, 90, 80, 70, 60, 50, 45, 40, 35 or 30 nucleotides in length. In some embodiments the 5' spacer sequence is between 5 and 50, 10 and 50, 20 and 50, 20 and 40, and/or 25 and 35 nucleotides in length. In certain embodiments, the 5' spacer sequence is 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 nucleotides in length. In one embodiment, the 5' spacer sequence is a polyA sequence. In another embodiment, the 5' spacer sequence is a polyAC sequence. In one embodiment, a spacer comprises about 10%, 20%, 30%, 40%, 50%, 60%, 70%, 80%, 90%, or 100% polyAC content. In one embodiment, a spacer comprises about 10%, 20%, 30%, 40%, 50%, 60%, 70%, 80%, 90%, or 100% polypyrimidine (C/T or C/U) content.

In some embodiments, the DNA template and precursor linear RNA polynucleotides and circular RNA polynucleotide provided herein comprise a first (5') duplex region and a second (3') duplex region. In certain embodiments, the DNA template and precursor linear RNA polynucleotide comprises a 5' external duplex region located within the 3' enhanced intron fragment and a 3' external duplex region located within the 5' enhanced intron fragment. In some embodiments, the DNA template, precursor linear RNA polynucleotide and circular RNA polynucleotide comprise a 5' internal duplex region located within the 3' enhanced exon fragment and a 3' internal duplex region located within the 5' enhanced exon fragment. In some embodiments, the DNA polynucleotide and precursor linear RNA polynucleotide comprises a 5' external duplex region, 5' internal duplex region, a 3' internal duplex region, and a 3' external duplex region.

In certain embodiments, the first and second duplex regions may form perfect or imperfect duplexes. Thus, in certain embodiments at least 75%, 80%, 85%, 90%, 91%, 92%, 93%, 94%, 95%, 96%, 97%, 98%, 99% or 100% of the first and second duplex regions may be base paired with one another. In some embodiments, the duplex regions are predicted to have less than 50% (e.g., less than 45%, less than 40%, less than 35%, less than 30%, less than 25%) base pairing with unintended sequences in the RNA (e.g., non-duplex region sequences). In some embodiments, including such duplex regions on the ends of the precursor RNA strand, and adjacent or very close to the group I intron fragment, bring the group I intron fragments in close proximity to each other, increasing splicing efficiency. In some embodiments, the duplex regions are 3 to 100 nucleotides in length (e.g., 3-75 nucleotides in length, 3-50 nucleotides in length, 20-50 nucleotides in length, 35-50 nucleotides in length, 5-25 nucleotides in length, 9-19 nucleotides in length). In some embodiments, the duplex regions are about 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 nucleotides in length. In some embodiments, the duplex regions have a length of about 9 to about 50 nucleotides. In one embodiment, the duplex regions have a length of about 9 to about 19 nucleotides. In some embodiments, the duplex regions have a length of about 20 to about 40 nucleotides. In certain embodiments, the duplex regions have a length of about 30 nucleotides.

In other embodiments, the DNA template, precursor linear RNA polynucleotide, or circular RNA polynucleotide does not comprise of any duplex regions to optimize translation or circularization.

As provided herein, the DNA template or precursor linear RNA polynucleotide may comprise an affinity tag. In some embodiments, the affinity tag is located in the 3' enhanced intron element. In some embodiments, the affinity tag is located in the 5' enhanced intron element. In some embodiments, both (3' and 5') enhanced intron elements each comprise an affinity tag. In one embodiment, an affinity tag of the 3' enhanced intron element is the length as an affinity tag in the 5' enhanced intron element. In some embodiments, an affinity tag of the 3' enhanced intron element is the same sequence as an affinity tag in the 5' enhanced intron element. In some embodiments, the affinity sequence is placed to optimize oligo-dT purification.

Figure 97A:
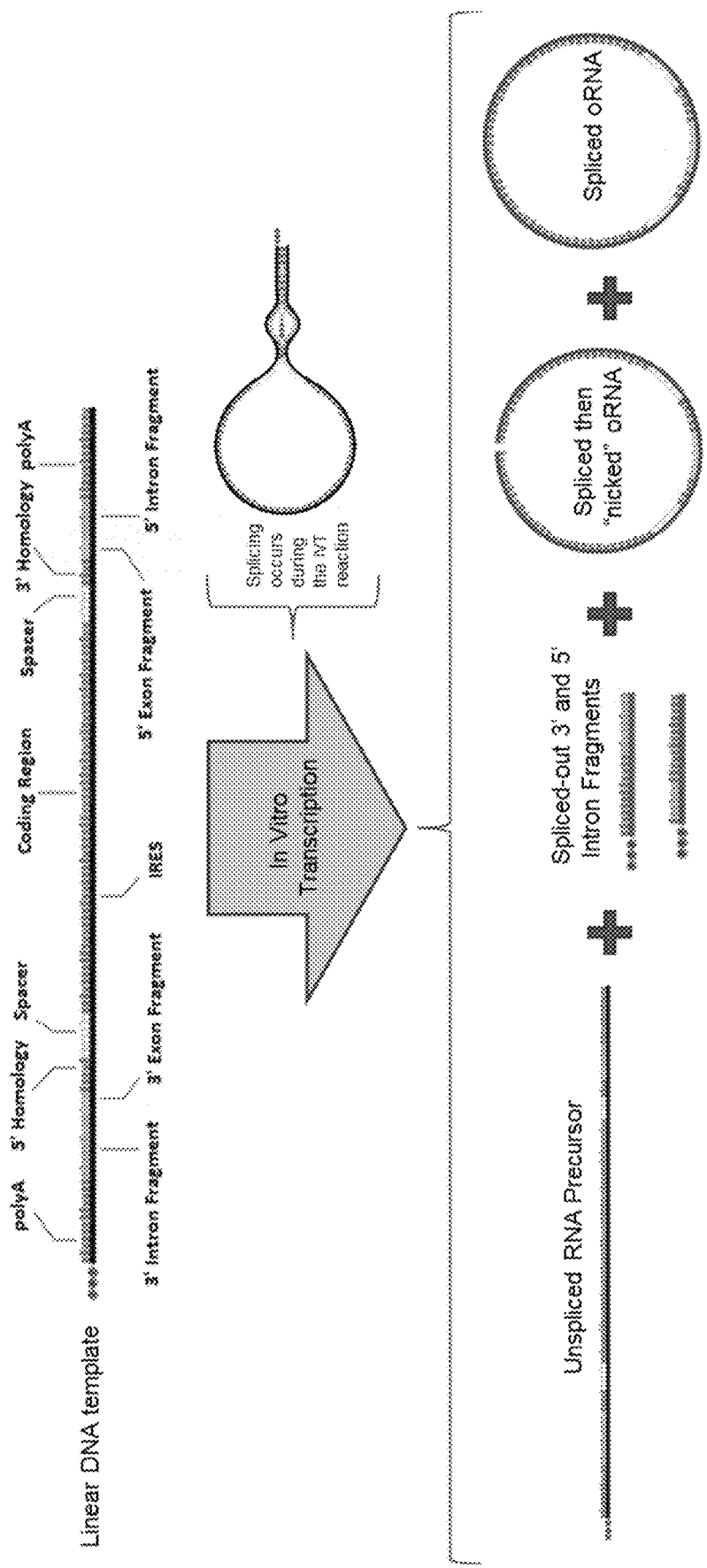
FIGS. 97A and 97B show an exemplary RNA circularization process. The schematic shown in FIG. 97A depicts an autocatalytic circularization process. Briefly, precursor RNA molecules containing intron segments and accessory elements that enhance circularization efficiency undergo splicing, resulting in a synthetic circular RNA and two excised intron/accessory sequence segments (spliced out intron segments/fragments). Some circularized RNA (oRNA) is nicked during synthesis.
Figure 97B:
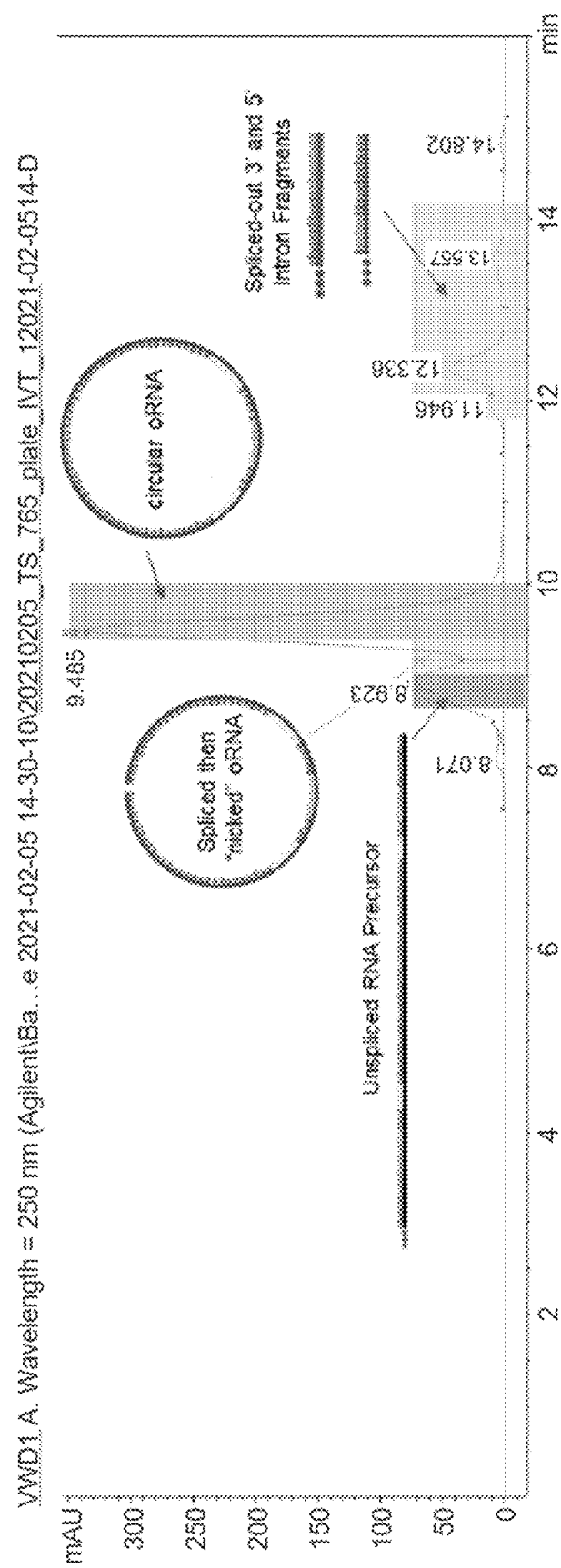

In some embodiments, the one or more affinity tags present in a precursor linear RNA polynucleotide are removed upon circularization. See, for example, FIG. 97A and FIG. 97B. In some embodiments, affinity tags are added to remaining linear RNA after circularization of RNA is performed. In some such embodiments, the affinity tags are added enzymatically to linear RNA. The presence of one or more affinity tags in linear RNA and their absence from circular RNA can facilitate purification of circular RNA. In some embodiments, such purification is performed using a negative selection or affinity-purification method. In some embodiments, such purification is performed using a binding agent that preferentially or specifically binds to the affinity tag.

In some embodiments, an affinity tag comprises a polyA region. In some embodiments the polyA region is at least 15, 30, or 60 nucleotides long. In some embodiments, the affinity tag comprising a polyA region is present in two places in a precursor linear RNA. In some embodiments, one or both polyA regions is 15-50 nucleotides long. In some embodiments, one or both polyA regions is 20-25 nucleotides long. The polyA sequence(s) is removed upon circularization. Thus, an oligonucleotide hybridizing with the polyA sequence, such as a deoxythymidine oligonucleotide (oligo(dT)) conjugated to a solid surface (e.g., a resin), can be used to separate circular RNA from its precursor RNA.

In some embodiments, an affinity tag comprises a sequence that is absent from the circular RNA product. In some such embodiments, the sequence that is absent from the circular RNA product is a dedicated binding site (DBS). In some embodiments, the DBS is an unstructured sequence, i.e., a sequence that does not form a defined structural element, such as a hairpin loop, contiguous dsRNA region, or triple helix. In some embodiments, the DBS sequence forms a random coil. In some embodiments, the DBS comprises at least 25% GC content, at least 50% GC content, at least 75% GC content, or at least 100% GC content. In some embodiments, the DBS comprises at least 25% AC content, at least 50% AC content, at least 75% AC content, or 100% AC content. In some embodiments, the DBS is at least 15, 30, or 60 nucleotides long. In some embodiments, the affinity tag comprising a DBS is present in two places in a precursor linear RNA. In some embodiments, the DBS sequences are each independently 15-50 nucleotides long. In some embodiments, the DBS sequences are each independently 20-25 nucleotides long.

In some embodiments, the DBS sequence(s) is removed upon circularization. Thus, binding agents comprising oligonucleotides comprising a sequence that is complementary to the DBS can be used to facilitate purification of circular RNA. For example, the binding agent may comprise an oligonucleotide complementary to a DBS conjugated to a solid surface (e.g., a resin).

In some embodiments, an affinity sequence or other type of affinity handle, such as biotin, is added to linear RNA by ligation. In some embodiments, an oligonucleotide comprising an affinity sequence is ligated to the linear RNA. In some embodiments, an oligonucleotide conjugated to an affinity handle is ligated to the linear RNA. In some embodiments, a solution comprising the linear RNA ligated to the affinity sequence or handle and the circular RNA that does not comprise an affinity sequence or handle are contacted with a binding agent comprising a solid support conjugated to an oligonucleotide complementary to the affinity sequence or to a binding partner of the affinity handle, such that the linear RNA binds to the binding agent, and the circular RNA is eluted or separated from the solid support.

Any purification method for circular RNA described herein may comprise one or more buffer exchange steps. In some embodiments, buffer exchange is performed after in vitro transcription (IVT) and before additional purification steps. In some such embodiments, the IVT reaction solution is buffer exchanged into a buffer comprising Tris. In some embodiments, the IVT reaction solution is buffer exchanged into a buffer comprising greater than 1 mM or greater than 10 mM one or more monovalent salts, such as NaCl or KCl, and optionally comprising EDTA. In some embodiments, buffer exchange is performed after purification of circular RNA is complete. In some embodiments, buffer exchange is performed after IVT and after purification of circular RNA. In some embodiments, the buffer exchange that is performed after purification of circular RNA comprises exchange of the circular RNA into water or storage buffer. In some embodiments, the storage buffer comprises 1 mM sodium citrate, pH 6.5.

In certain embodiments, the 3' enhanced intron element comprises a leading untranslated sequence. In some embodiments, the leading untranslated sequence is a the 5' end of the 3' enhanced intron fragment. In some embodiments, the leading untranslated sequence comprises of the last nucleotide of a transcription start site (TSS). In some embodiments, the TSS is chosen from a viral, bacterial, or eukaryotic DNA template. In one embodiment, the leading untranslated sequence comprise the last nucleotide of a TSS and 0 to 100 additional nucleotides. In some embodiments, the TSS is a terminal spacer. In one embodiment, the leading untranslated sequence contains a guanosine at the 5' end upon translation of an RNA T7 polymerase.

In certain embodiments, the 5' enhanced intron element comprises a trailing untranslated sequence. In some embodiments, the 5' trailing untranslated sequence is located at the 3' end of the 5' enhanced intron element. In some embodiments, the trailing untranslated sequence is a partial restriction digest sequence. In one embodiment, the trailing untranslated sequence is in whole or in part a restriction digest site used to linearize the DNA template. In some embodiments, the restriction digest site is in whole or in part from a natural viral, bacterial or eukaryotic DNA template. In some embodiments, the trailing untranslated sequence is a terminal restriction site fragment.

a. Enhanced Intron Fragments

According to the present invention, the 3' enhanced intron element and 5' enhanced intron element each comprise an intron fragment. In certain embodiments, a 3' intron fragment is a contiguous sequence at least 75% homologous (e.g., at least 80%, 85%, 90%, 91%, 92%, 93%, 94%, 95%, 96%, 97%, 98%, 99% or 100% homologous) to a 3' proximal fragment of a natural group I intron including the 3' splice site dinucleotide. Typically, a 5' intron fragment is a contiguous sequence at least 75% homologous (e.g., at least 80%, 85%, 90%, 91%, 92%, 93%, 94%, 95%, 96%, 97%, 98%, 99% or 100% homologous) to a 5' proximal fragment of a natural group I intron including the 5' splice site dinucleotide. In some embodiments, the 3' intron fragment includes the first nucleotide of a 3' group I splice site dinucleotide. In some embodiments, the 5' intron fragment includes the first nucleotide of a 5' group I splice site dinucleotide. In other embodiments, the 3' intron fragment includes the first and second nucleotides of a 3' group I intron fragment splice site dinucleotide; and the 5' intron fragment includes the first and second nucleotides of a 3' group I intron fragment dinucleotide.

b. Enhanced Exon Fragments

In certain embodiments, as provided herein, the DNA template, linear precursor RNA polynucleotide, and circular RNA polynucleotide each comprise an enhanced exon fragment. In some embodiments, following a 5' to 3' order, the 3' enhanced exon element is located upstream to core functional element. In some embodiments, following a 5' to 3' order, the 5' enhanced intron element is located downstream to the core functional element.

According to the present invention, the 3' enhanced exon element and 5' enhanced exon element each comprise an exon fragment. In some embodiments, the 3' enhanced exon element comprises a 3' exon fragment. In some embodiments, the 5' enhanced exon element comprises a 5' exon fragment. In certain embodiments, as provided herein, the 3' exon fragment and 5' exon fragment each comprises a group I intron fragment and 1 to 100 nucleotides of an exon sequence. In certain embodiments, a 3' intron fragment is a contiguous sequence at least 75% homologous (e.g., at least 80%, 85%, 90%, 91%, 92%, 93%, 94%, 95%, 96%, 97%, 98%, 99% or 100% homologous) to a 3' proximal fragment of a natural group I intron including the 3' splice site dinucleotide. Typically, a 5' group I intron fragment is a contiguous sequence at least 75% homologous (e.g., at least 80%, 85%, 90%, 91%, 92%, 93%, 94%, 95%, 96%, 97%, 98%, 99% or 100% homologous) to a 5' proximal fragment of a natural group I intron including the 5' splice site dinucleotide. In some embodiments, the 3' exon fragment comprises a second nucleotide of a 3' group I intron splice site dinucleotide and 1 to 100 nucleotides of an exon sequence. In some embodiments, the 5' exon fragment comprises the first nucleotide of a 5' group I intron splice site dinucleotide and 1 to 100 nucleotides of an exon sequence. In some embodiments, the exon sequence comprises in part or in whole from a naturally occurring exon sequence from a virus, bacterium or eukaryotic DNA vector. In other embodiments, the exon sequence further comprises a synthetic, genetically modified (e.g., containing modified nucleotide), or other engineered exon sequence.

In one embodiment, where the 3' intron fragment comprises both nucleotides of a 3' group I splice site dinucleotide and the 5' intron fragment comprises both nucleotides of a 5' group I splice site dinucleotide, the exon fragments located within the 5' enhanced exon element and 3' enhanced exon element does not comprise of a group I splice site dinucleotide.

c. Examplar Permutation of the Enhanced Intron Elements & Enhanced Exon Elements For means of example and not intended to be limiting, in some embodiment, a 3' enhanced intron element comprises in the following 5' to 3' order: a leading untranslated sequence, a 5' affinity tag, an optional 5' external duplex region, a 5' external spacer, and a 3' intron fragment. In same embodiments, the 3' enhanced exon element comprises in the following 5' to 3' order: a 3' exon fragment, an optional 5' internal duplex region, an optional 5' internal duplex region, and a 5' internal spacer. In the same embodiments, the 5' enhanced exon element comprises in the following 5' to 3' order: a 3' internal spacer, an optional 3' internal duplex region, and a 5' exon fragment. In still the same embodiments, the 3' enhanced intron element comprises in the following 5' to 3' order: a 5' intron fragment, a 3' external spacer, an optional 3' external duplex region, a 3' affinity tag, and a trailing untranslated sequence.

B. Core Functional Element

In some embodiments, the DNA template, linear precursor RNA polynucleotide, and circular RNA polynucleotide comprise a core functional element. In some embodiments, the core functional element comprises a coding or noncoding element. In certain embodiments, the core functional element may contain both a coding and noncoding element. In some embodiments, the core functional element further comprises translation initiation element (TIE) upstream to the coding or noncoding element. In some embodiments, the core functional element comprises a termination element. In some embodiments, the termination element is located downstream to the TIE and coding element. In some embodiments, the termination element is located downstream to the coding element but upstream to the TIE. In certain embodiments, where the coding element comprises a noncoding region, a core functional element lacks a TIE and/or a termination element.

a. Coding or Noncoding Element

In some embodiments, the polynucleotides herein comprise coding or noncoding element or a combination of both. In some embodiments, the coding element comprises an expression sequence. In some embodiments, the coding element encodes at least one therapeutic protein.

In some embodiments, the circular RNA encodes two or more polypeptides. In some embodiments, the circular RNA is a bicistronic RNA. The sequences encoding the two or more polypeptides can be separated by a ribosomal skipping element or a nucleotide sequence encoding a protease cleavage site. In certain embodiments, the ribosomai skipping element encodes thosea-asigna virus 2A peptide (T2A), porcine teschovirus-1 2 A peptide (P2A), foot-and-mouth disease virus 2 A peptide (F2A), equine rhinitis A vims 2A peptide (E2A), cytoplasmic polyhedrosis vims 2A peptide (BmCPV 2A), or flacherie vims of *B. mori* 2A peptide (BmIFV 2A).

b. Translation Initiation Element (TIE)

As provided herein in some embodiments, the core functional element comprises at least one translation initiation element (TIE). TIEs are designed to allow translation efficiency of an encoded protein. Thus, optimal core functional elements comprising only of noncoding elements lack any TIEs. In some embodiments, core functional elements comprising one or more coding element will further comprise one or more TIEs.

In some embodiments, a TIE comprises an untranslated region (UTR). In certain embodiments, the TIE provided herein comprise an internal ribosome entry site (IRES). Inclusion of an IRES permits the translation of one or more open reading frames from a circular RNA (e.g., open reading frames that form the expression sequences). The IRES element attracts a eukaryotic ribosomal translation initiation complex and promotes translation initiation. See, e.g., Kaufman et al., Nuc. Acids Res. (1991) 19:4485-4490; Gurtu et al., Biochem. Biophys. Res. Comm. (1996) 229:295-298; Rees et al., BioTechniques (1996) 20: 102-110; Kobayashi et al., BioTechniques (1996) 21:399-402; and Mosser et al., BioTechniques 1997 22 150-161.

For driving protein expression, the circular RNA comprises an IRES operably linked to a protein coding sequence. Exemplary IRES sequences are provided in Table_A_IRES. In some embodiments, the circular RNA disclosed herein comprises an IRES sequence at least 80%, 85%, 90%, 91%, 92%, 93%, 94%, 95%, 96%, 97%, 98%, or 99% identical to an IRES sequence in Table_A_IRES. In some embodiments, the circular RNA disclosed herein comprises an IRES sequence in Table_A_IRES. Modifications of IRES and accessory sequences are disclosed herein to increase or reduce IRES activities, for example, by truncating the 5' and/or 3' ends of the IRES, adding a spacer 5' to the IRES, modifying the 6 nucleotides 5' to the translation initiation site (Kozak sequence), modification of alternative translation initiation sites, and creating chimeric/hybrid IRES sequences. In some embodiments, the IRES sequence in the circular RNA disclosed herein comprises one or more of these modifications relative to a native IRES (e.g., a native IRES disclosed in Table_A_IRES).

A multitude of IRES sequences are available and include sequences derived from a wide variety of viruses, such as from leader sequences of picornaviruses such as the encephalomyocarditis virus (EMCV) UTR (Jang et al. J. Virol. (1989) 63: 1651-1660), the polio leader sequence, the hepatitis A virus leader, the hepatitis C virus IRES, human rhinovirus type 2 IRES (Dobrikova et al., Proc. Natl. Acad. Sci. (2003) 100(25): 15125-15130), an IRES element from the foot and mouth disease virus (Ramesh et al., Nucl. Acid Res. (1996) 24:2697-2700), a giardiavirus IRES (Garlapati et al., J. Biol. Chem. (2004) 279(5):3389-3397), and the like.

i. Natural Ties: Viral, & Eukaryotic/Cellular Internal Ribosome Entry Site (IRES)

A multitude of IRES sequences are available and include sequences derived from a wide variety of viruses, such as from leader sequences of picornaviruses such as the encephalomyocarditis virus (EMCV) UTR (Jang et al., J. Virol. (1989) 63: 1651-1660), the polio leader sequence, the hepatitis A virus leader, the hepatitis C virus IRES, human rhinovirus type 2 IRES (Dobrikova et al., Proc. Natl. Acad. Sci. (2003) 100(25): 15125-15130), an IRES element from the foot and mouth disease virus (Ramesh et al., Nucl. Acid Res. (1996) 24:2697-2700), a giardiavirus IRES (Garlapati et al., J. Biol. Chem. (2004) 279(5):3389-3397), and the like. Different IRES sequences have varying ability to drive protein expression, and the ability of any particular identified or predicted IRES sequence to drive protein expression from linear mRNA or circular RNA constructs is unknown and unpredictable. In certain embodiments, potential IRES sequences can be bioinformatically identified based on sequence positions in viral sequences. However, the activity of such sequences has been previously uncharacterized. As demonstrated herein, such IRES sequences may have differing protein expression capability depending on cell type, for example in T cells, liver cells, or muscle cells. In some embodiments, the novel IRES sequences described herein may have at least 2, 3, 4, 5, 6, 7, 8, 9, 10, 20, 50, or 100 fold increased expression in a particular cell type compared to previously described EMCV IRES sequences.

For driving protein expression, the circular RNA comprises an IRES operably linked to a protein coding sequence. Exemplary IRES sequences are provided in Table_A_IRES. In some embodiments, the circular RNA disclosed herein comprises an IRES sequence at least 80%, 85%, 90%, 91%, 92%, 93%, 94%, 95%, 96%, 97%, 98%, or 99% identical to an IRES sequence in Table_A_IRES. In some embodiments, the circular RNA disclosed herein comprises an IRES sequence in Table_A_IRES. Modifications of IRES and accessory sequences are disclosed herein to increase or reduce IRES activities, for example, by truncating the 5' and/or 3' ends of the IRES, adding a spacer 5' to the IRES, modifying the 6 nucleotides 5' to the translation initiation site (Kozak sequence), modification of alternative translation initiation sites, and creating chimeric/hybrid IRES sequences. In some embodiments, the IRES sequence in the circular RNA disclosed herein comprises one or more of these modifications relative to a native IRES (e.g., a native IRES disclosed in Table_A_IRES).

In some embodiments, the IRES is an Aalivirus, Ailurivirus, Ampivirus, Anativirus, Aphthovirus, Aquamavirus, Avihepatovirus, Avisivirus, Boosepivirus, Bopivirus, Caecilivirus, Cardiovirus, Cosavirus, Crahelivirus, Crohivirus, Danipivirus, Dicipivirus, Diresapivirus, Enterovirus, Erbovirus, Felipivirus, Fipivirus, Gallivirus, Gruhelivirus, Grusopivirus, Harkavirus, Hemipivirus, Hepatovirus, Hunnivirus, Kobuvirus, Kunsagivirus, Limnipivirus, Livupivirus, Ludopivirus, Malagasivirus, Marsupivirus, Megrivirus, Mischivirus, Mosavirus, Mupivirus, Myrropivirus, Orivirus, Oscivirus, Parabovirus, Parechovirus, Pasivirus, Passerivirus, Pemapivirus, Poecivirus, Potamipivirus, Pygoscepivirus, Rabovirus, Rafivirus, Rajidapivirus, Rohelivirus, Rosavirus, Sakobuvirus, Salivirus, Sapelovirus, Senecavirus, Shanbavirus, Sicinivirus, Symapivirus, Teschovirus, Torchivirus, Tottorivirus, Tremovirus, Tropivirus, Hepacivirus, Pegivirus, Pestivirus, Flavivirus IRES.

In some embodiments, the IRES is an IRES sequence of Taura syndrome virus, *Triatoma* virus, Theiler's encephalomyelitis virus, Simian Virus 40, *Solenopsis invicta* virus 1, *Rhopalosiphum padi* virus, Reticuloendotheliosis virus, Human poliovirus 1, *Plautia stali* intestine virus, Kashmir bee virus, Human rhinovirus 2, *Homalodisca coagulata* virus-1, Human Immunodeficiency Virus type 1, Himetobi P virus, Hepatitis C virus, Hepatitis A virus, Hepatitis GB virus, Foot and mouth disease virus, Human enterovirus 71, Equine rhinitis virus, Ectropis obliqua picorna-like virus, Encephalomyocarditis virus, *Drosophila* C Virus, Human coxsackievirus B3, Crucifer tobamovirus, Cricket paralysis virus, Bovine viral diarrhea virus 1, Black Queen Cell Virus, Aphid lethal paralysis virus, Avian encephalomyelitis virus, Acute bee paralysis virus, Hibiscus chlorotic ringspot virus, Classical swine fever virus, Human FGF2, Human SFTPA1, Human AML1/RUNX1, *Drosophila* antennapedia, Human AQP4, Human AT1R, Human BAG-1, Human BCL2, Human BiP, Human c-IAPI, Human c-myc, Human eIF4G, Mouse NDST4L, Human LEF1, Mouse HIF1 alpha, Human n.myc, Mouse Gtx, Human p27kip1, Human PDGF2/c-sis, Human p53, Human Pim-1, Mouse Rbm3, *Drosophila* reaper, Canine Scamper, *Drosophila* Ubx, Human UNR, Mouse UtrA, Human VEGF-A, Human XIAP, *Drosophila* hairless, *S. cerevisiae* TFIID, *S. cerevisiae* YAP1, tobacco etch virus, turnip crinkle virus, EMCV-A, EMCV-B, EMCV-Bf, EMCV-Cf, EMCV pEC9, Picobirnavirus, HCV QC64, Human Cosavirus E/D, Human Cosavirus F, Human Cosavirus JMY, Rhinovirus NAT001, HRV14, HRV89, HRVC-02, HRV-A21, Salivirus A SH1, Salivirus FHB, Salivirus NG-J1, Human Parechovirus 1, Crohivirus B, Yc-3, Rosavirus M-7, Shanbavirus A, Pasivirus A, Pasivirus A 2, Echovirus E14, Human Parechovirus 5, Aichi Virus, Hepatitis A Virus HA16, Phopivirus, CVA10, Enterovirus C, Enterovirus D, Enterovirus J, Human Pegivirus 2, GBV-C GT110, GBV-C K1737, GBV-C Iowa, Pegivirus A 1220, Pasivirus A 3, Sapelovirus, Rosavirus B, Bakunsa Virus, Tremovirus A, Swine Pasivirus 1, PLV-CHN, Pasivirus A, Sicinivirus, Hepacivirus K, Hepacivirus A, BVDV1, Border Disease Virus, BVDV2, CSFV-PK15C, SF573 Dicistrovirus, Hubei Picorna-like Virus, CRPV, Salivirus A BN5, Salivirus A BN2, Salivirus A 02394, Salivirus A GUT, Salivirus A CH, Salivirus A SZ1, Salivirus FHB, CVB3, CVB1, Echovirus 7, CVB5, EVA71, CVA3, CVA12, EV24 or an aptamer to eIF4G.

In some embodiments, the IRES comprises in whole or in part from a eukaryotic or cellular IRES. In certain embodiments, the IRES is from a human gene, where the human gene is ABCF1, ABCG1, ACAD10, ACOT7, ACSS3, ACTG2, ADCYAP1, ADK, AGTR1, AHCYL2, AHIl, AKAP8L, AKR1A1, ALDH3A1, ALDOA, ALG13, AMMECRIL, ANGPTL4, ANK3, AOC3, AP4B1, AP4E1, APAF1, APBB1, APC, APH1A, APOBEC3D, APOM, APP, AQP4, ARHGAP36, ARL13B, ARMC8, ARMCX6, ARPC1A, ARPC2, ARRDC3, ASAP1, ASB3, ASB5, ASCL1, ASMTL, ATF2, ATF3, ATG4A, ATP5B, ATP6V0A1, ATXN3, AURKA, AURKA, AURKA, AURKA, B3GALNT1, B3GNTL1, B4GALT3, BAAT, BAG1, BAIAP2, BAIAP2L2, BAZ2A, BBX, BCAR1, BCL2, BCS1L, BET1, BID, BIRC2, BPGM, BPIFA2, BRINP2, BSG, BTN3A2, C12orf43, C14orf93, C17orf62, Clorf226, C21orf62, C2orf15, C4BPB, C4orf22, C9orf84, CACNA1A, CALCOCO2, CAPN11, CASP12, CASP8AP2, CAV1, CBX5, CCDC120, CCDC17, CCDC186, CCDC51, CCN1, CCND1, CCNT1, CD2BP2, CD9, CDC25C, CDC42, CDC7, CDCA7L, CDIP1, CDK1, CDK11A, CDKN1B, CEACAM7, CEP295NL, CFLAR, CHCHD7, CHIA, CHIC1, CHMP2A, CHRNA2, CLCN3, CLEC12A, CLEC7A, CLECLI, CLRN1, CMSS1, CNIH1, CNR1, CNTN5, COG4, COMMD1, COMMD5, CPEB1, CPS1, CRACR2B, CRBN, CREM, CRYBG1, CSDE1, CSF2RA, CSNK2A1, CSTF3, CTCFL, CTH, CTNNA3, CTNNB1, CTNNB1, CTNND1, CTSL, CUTA, CXCR5, CYB5R3, CYP24A1, CYP3A5, DAG1, DAP3, DAP5, DAXX, DCAF4, DCAF7, DCLRE1A, DCP1A, DCTN1, DCTN2, DDX19B, DDX46, DEFB123, DGKA, DGKD, DHRS4, DHX15, DI03, DLG1, DLL4, DMD UTR, DMD ex5, DMKN, DNAH6, DNAL4, DUSP13, DUSP19, DYNC1I2, DYNLRB2, DYRKIA, ECI2, ECT2, EIF1AD, EIF2B4, EIF4G1, EIF4G2, EIF4G3, ELANE, ELOVL6, ELP5, EMCN, ENOl, EPB41, ERMN, ERVV-1, ESRRG, ETFB, ETFBKMT, ETV1, ETV4, EXD1, EXT1, EZH2, FAM111B, FAM157A, FAM213A, FBXO25, FBXO9, FBXW7, FCMR, FGF1, FGF1, FGF1A, FGF2, FGF2, FGF-9, FHL5, FMR1, FN1, FOXP1, FTH1, FUBP1, G3BP1, GABBR1, GALC, GART, GAS7, gastrin, GATA1, GATA4, GFM2, GHR, GJB2, GLIl, GLRA2, GMNN, GPAT3, GPATCH3, GPR137, GPR34, GPR55, GPR89A, GPRASP1, GRAP2, GSDMB, GSTO2, GTF2B, GTF2H4, GUCY1B2, HAX1, HCST, HIGD1A, HIGD1B, HIPK1, HIST1HIC, HIST1H3H, HK1, HLA-DRB4, HMBS, HMGA1, HNRNPC, HOPX, HOXA2, HOXA3, HPCAL1, HR, HSP90AB1, HSPA1A, HSPA4L, HSPA5, HYPK, IFFO1, IFT74, IFT81, IGF1, IGF1R, IGF1R, IGF2, IL11, IL17RE, IL1RL1, IL1RN, IL32, IL6, ILF2, ILVBL, INSR, INTS13, IP6K1, ITGA4, ITGAE, KCNE4, KERA, KIAA0355, KIAA0895L, KIAA1324, KIAA1522, KIAA1683, KIF2C, KIZ, KLHL31, KLK7, KRR1, KRT14, KRT17, KRT33A, KRT6A, KRTAP10-2, KRTAP13-3, KRTAP13-4, KRTAP5-11, KRTCAP2, LACRT, LAMB1, LAMB3, LANCL1, LBX2, LCAT, LDHA, LDHAL6A, LEF1, LINC-PINT, LMO3, LRRC4C, LRRC7, LRTOMT, LSM5, LTB4R, LYRM1, LYRM2, MAGEAI1, MAGEA8, MAGEBI, MAGEB16, MAGEB3, MAPT, MARS, MC1R, MCCC1, METTL12, METTL7A, MGC16025, MGC16025, MIA2, MIA2, MITF, MKLN1, MNT, MORF4L2, MPD6, MRFAPI, MRPL21, MRPS12, MSI2, MSLN, MSN, MT2A, MTFR1L, MTMR2, MTRR, MTUS1, MYB, MYC, MYCL, MYCN, MYL10, MYL3, MYLK, MYO1A, MYT2, MZB1, NAP1L1, NAV1, NBAS, NCF2, NDRG1, NDST2, NDUFA7, NDUFB11, NDUFC1, NDUFS1, NEDD4L, NFAT5, NFE2L2, NFE2L2, NFIA, NHEJ1, NHP2, NIT1, NKRF, NME1-NME2, NPAT, NR3C1, NRBF2, NRF1, NTRK2, NUDCD1, NXF2, NXT2, ODC1, ODF2, OPTN, OR10R2, OR11L1, OR2M2, OR2M3, OR2M5, OR2T10, OR4C15, OR4F17, OR4F5, OR5H1, OR5K1, OR6C3, OR6C75, OR6N1, OR7G2, p53, P2RY4, PAN2, PAQR6, PARP4, PARP9, PC, PCBP4, PCDHGC3, PCLAF, PDGFB, PDZRN4, PELO, PEMT, PEX2, PFKM, PGBD4, PGLYRP3, PHLDA2, PHTF1, PI4 KB, PIGC, PIM1, PKD2L1, PKM, PLCB4, PLD3, PLEKHA1, PLEKHB1, PLS3, PML, PNMA5, PNN, POC1A, POC1B, POLD2, POLD4, POU5F1, PPIG, PQBP1, PRAME, PRPF4, PRR11, PRRT1, PRSS8, PSMA2, PSMA3, PSMA4, PSMD11, PSMD4, PSMD6, PSME3, PSMG3, PTBP3, PTCH1, PTHLH, PTPRD, PUS7L, PVRIG, QPRT, RAB27A, RAB7B, RABGGTB, RAETIE, RALGDS, RALYL, RARB, RCVRN, REG3G, RFC5, RGL4, RGS19, RGS3, RHD, RINL, RIPOR2, RITA1, RMDN2, RNASE1, RNASE4, RNF4, RPA2, RPL17, RPL21, RPL26L1, RPL28, RPL29, RPL41, RPL9, RPS11, RPS13, RPS14, RRBP1, RSU1, RTP2, RUNX1, RUNX1T1, RUNX1T1, RUNX2, RUSC1, RXRG, S100A13, S100A4, SAT1, SCHIP1, SCMH1, SEC14L1, SEMA4A, SERPINA1, SERPINB4, SERTAD3, SFTPD, SH3D19, SHC1, SHMT1, SHPRH, SIM1, SIRT5, SLC11A2, SLC12A4, SLC16A1, SLC25A3, SLC26A9, SLC5A11, SLC6A12, SLC6A19, SLC7A1, SLFN11, SLIRP, SMAD5, SMARCADI, SMN1, SNCA, SNRNP200, SNRPB2, SNX12, SOD1, SOX13, SOX5, SP8, SPARCL1, SPATA12, SPATA31C2, SPN, SPOP, SQSTM1, SRBD1, SRC, SREBF1, SRPK2, SSB, SSB, SSBP1, ST3GAL6, STAB1, STAMBP, STAU1, STAU1, STAU1, STAU1, STAU1, STK16, STK24, STK38, STMN1, STX7, SULT2B1, SYK, SYNPR, TAF1C, TAGLN, TANK, TAS2R40, TBC1D15, TBXAS1, TCF4, TDGF1, TDP2, TDRD3, TDRD5, TESK2, THAP6, THBD, THTPA, TIAM2, TKFC, TKTL1, TLR10, TM9SF2, TMC6, TMCO2, TMED10, TMEM116, TMEM126A, TMEM159, TMEM208, TMEM230, TMEM67, TMPRSS13, TMUB2, TNFSF4, TNIP3, TP53, TP53, TP73, TRAF1, TRAK1, TRIM31, TRIM6, TRMT1, TRMT2B, TRPM7, TRPM8, TSPEAR, TTC39B, TTLL11, TUBB6, TXLNB, TXNIP, TXNL1, TXNRD1, TYROBP, U2AF1, UBA1, UBE2D3, UBE2I, UBE2L3, UBE2V1, UBE2V2, UMPS, UNG, UPP2, USMG5, USP18, UTP14A, UTRN, UTS2, VDR, VEGFA, VEGFA, VEPH1, VIPAS39, VPS29, VSIG10L, WDHD1, WDR12, WDR4, WDR45, WDYHV1, WRAP53, XIAP, XPNPEP3, YAP1, YWHAZ, YY1AP1, ZBTB32, ZNF146, ZNF250, ZNF385A, ZNF408, ZNF410, ZNF423, ZNF43, ZNF502, ZNF512, ZNF513, ZNF580, ZNF609, ZNF707, or ZNRD1.

ii. Synthetic Ties: Aptamer Complexes, Modified Nucleotides, IRES Variants & Other Engineered Ties As contemplated herein, in certain embodiments, a translation initiation element (TIE) comprises a synthetic TIE. In some embodiments, a synthetic TIE comprises aptamer complexes, synthetic IRES or other engineered TIES capable of initiating translation of a linear RNA or circular RNA polynucleotide.

In some embodiments, one or more aptamer sequences is capable of binding to a component of a eukaryotic initiation factor to either enhance or initiate translation. In some embodiments, aptamer may be used to enhance translation in vivo and in vitro by promoting specific eukaryotic initiation factors (eIF) (e.g., aptamer in WO2019081383A1 is capable of binding to eukaryotic initiation factor 4F (eIF4F). In some embodiments, the aptamer or a complex of aptamers may be capable of binding to EIF4G, EIF4E, EIF4A, EIF4B, EIF3, EIF2, EIF5, EIF1, EIF1A, 40S ribosome, PCBP1 (polyC binding protein), PCBP2, PCBP3, PCBP4, PABP1 (polyA binding protein), PTB, Argonaute protein family, HNRNPK (heterogeneous nuclear ribonucleoprotein K), or La protein.

c. Termination Sequence

In certain embodiments, the core functional element comprises a termination sequence. In some embodiments, the termination sequence comprises a stop codon. In one embodiment, the termination sequence comprises a stop cassette. In some embodiments, the stop cassette comprises at least 2 stop codons. In some embodiments, the stop cassette comprises at least 2 frames of stop codons. In the same embodiment, the frames of the stop codons in a stop cassette each comprise 1, 2 or more stop codons. In some embodiments, the stop cassette comprises a LoxP or a RoxStopRox, or frt-flanked stop cassette. In the same embodiment, the stop cassette comprises a lox-stop-lox stop cassette.

C. Variants

In certain embodiments, a circular RNA polynucleotide provided herein comprises modified RNA nucleotides and/or modified nucleosides. In some embodiments, the modified nucleoside is $m^5C$ (5-methylcytidine). In another embodiment, the modified nucleoside is $m^5U$ (5-methyluridine). In another embodiment, the modified nucleoside is $m^6A$ ($N^6$-methyladenosine). In another embodiment, the modified nucleoside is $s^2U$ (2-thiouridine). In another embodiment, the modified nucleoside is Ψ (pseudouridine). In another embodiment, the modified nucleoside is Um (2'-O-methyluridine). In other embodiments, the modified nucleoside is $m^1A$ (1-methyladenosine); $m^2A$ (2-methyladenosine); Am (2'-O-methyladenosine); $ms^2m^6A$ (2-methylthio-$N^6$-methyladenosine); $i^6A$ ($N^6$-isopentenyladenosine); $ms^2i6A$ (2-methylthio-$N^6$ isopentenyladenosine); $io^6A$ ($N^6$-(cis-hydroxyisopentenyl)adenosine); $ms^2io^6A$ (2-methylthio-$N^6$-(cis-hydroxyisopentenyl)adenosine); $g^6A$ ($N^6$-glycinylcarbamoyladenosine); $t^6A$ ($N^6$-threonylcarbamoyladenosine); $ms^2t^6A$ (2-methylthio-$N^6$-threonyl carbamoyladenosine); $m^6t^6A$ ($N^6$-methyl-$N^6$-threonylcarbamoyladenosine); $hn^6A$ ($N^6$-hydroxynorvalylcarbamoyladenosine); $ms^2hn^6A$ (2-methylthio-$N^6$-hydroxynorvalyl carbamoyladenosine); Ar(p) (2'-O-ribosyladenosine (phosphate)); I (inosine); $m^1I$ (1-methylinosine); $m^1Im$ (1,2'-O-dimethylinosine); $m^3C$ (3-methylcytidine); Cm (2'-O-methylcytidine); $s^2C$ (2-thiocytidine); $ac^4C$ ($N^4$-acetylcytidine); fC (5-formylcytidine); $m^5Cm$ (5,2'-O-dimethylcytidine); $ac^4Cm$ ($N^4$-acetyl-2'-O-methylcytidine); $k^2C$ (lysidine); $m^1G$ (1-methylguanosine); $m^2G$ ($N^2$-methylguanosine); $m^7G$ (7-methylguanosine); Gm (2'-O-methylguanosine); $m^2{}_2G$ ($N^2,N^2$-dimethylguanosine); $m^2Gm$ ($N^2,2'$-O-dimethylguanosine); $m^2{}_2Gm$ ($N^2,N^2,2'$-O-trimethylguanosine); Gr(p) (2'-O-ribosylguanosine (phosphate)); yW (wybutosine); $o_2yW$ (peroxywybutosine); OHyW (hydroxywybutosine); OHyW* (undermodified hydroxywybutosine); imG (wyosine); mimG (methylwyosine); Q (queuosine); oQ (epoxyqueuosine); galQ (galactosyl-queuosine); manQ (mannosyl-queuosine); $preQ_0$ (7-cyano-7-deazaguanosine); $preQ_1$ (7-aminomethyl-7-deazaguanosine); G+(archaeosine); D (dihydrouridine); $m^5Um$ (5,2'-O-dimethyluridine); $s^4U$ (4-thiouridine); $m^5s^2U$ (5-methyl-2-thiouridine); $s^2Um$ (2-thio-2'-O-methyluridine); $acp^3U$ (3-(3-amino-3-carboxypropyl)uridine); $ho^5U$ (5-hydroxyuridine); $mo^5U$ (5-methoxyuridine); $cmo^5U$ (uridine 5-oxyacetic acid); $mcmo^5U$ (uridine 5-oxyacetic acid methyl ester); $chm^5U$ (5-(carboxyhydroxymethyl)uridine)); $mchm^5U$ (5-(carboxyhydroxymethyl)uridine methyl ester); $mcm^5U$ (5-methoxycarbonylmethyluridine); $mcm^5Um$ (5-methoxycarbonylmethyl-2'-O-methyluridine); $mcm^5s^2U$ (5-methoxycarbonylmethyl-2-thiouridine); $nm^5S^2U$ (5-aminomethyl-2-thiouridine); $mnm^5U$ (5-methylaminomethyluridine); $mnm^5s^2U$ (5-methylaminomethyl-2-thiouridine); $mnm^5se^2U$ (5-methylaminomethyl-2-selenouridine); $nCm^5U$ (5-carbamoylmethyluridine); $nCm^5Um$ (5-carbamoylmethyl-2'-O-methyluridine); $cmnm^5U$ (5-carboxymethylaminomethyluridine); $cmnm^5Um$ (5-carboxymethylaminomethyl-2'-O-methyluridine); $cmnm^5s^2U$ (5-carboxymethylaminomethyl-2-thiouridine); $m^6{}_2A$ ($N^6,N^6$-dimethyladenosine); Im (2'-O-methylinosine); $m^4C$ ($N^4$-methylcytidine); $m^4Cm$ ($N^4,2'$-O-dimethylcytidine); $hm^5C$ (5-hydroxymethylcytidine); $m^3U$ (3-methyluridine); $cm^5U$ (5-carboxymethyluridine); $m^6Am$ ($N^6,2'$-O-dimethyladenosine); $m^6{}_2Am$ ($N^6,N^6,O$-2'-trimethyladenosine); $m^{2,7}G$ ($N^2,7$-dimethylguanosine); $m^{2,2,7}G$ ($N^2,N^2,7$-trimethylguanosine); $m^3Um$ (3,2'-O-dimethyluridine); $m^5D$ (5-methyldihydrouridine); $f^5Cm$ (5-formyl-2'-O-methylcytidine); $m^1Gm$ (1,2'-O-dimethylguanosine); $m^1Am$ (1,2'-O-dimethyladenosine); $Tm^5U$ (5-taurinomethyluridine); $τm^5s^2U$ (5-taurinomethyl-2-thiouridine)); imG-14 (4-demethylwyosine); imG2 (isowyosine); or $ac^6A$ ($N^6$-acetyladenosine).

In some embodiments, the modified nucleoside may include a compound selected from the group of: pyridin-4-one ribonucleoside, 5-aza-uridine, 2-thio-5-aza-uridine, 2-thiouridine, 4-thio-pseudouridine, 2-thio-pseudouridine, 5-hydroxyuridine, 3-methyluridine, 5-carboxymethyl-uridine, 1-carboxymethyl-pseudouridine, 5-propynyl-uridine, 1-propynyl-pseudouridine, 5-taurinomethyluridine, 1-taurinomethyl-pseudouridine, 5-taurinomethyl-2-thio-uridine, 1-taurinomethyl-4-thio-uridine, 5-methyl-uridine, 1-methyl-pseudouridine, 4-thio-1-methyl-pseudouridine, 2-thio-1-methyl-pseudouridine, 1-methyl-1-deaza-pseudouridine, 2-thio-1-methyl-1-deaza-pseudouridine, dihydrouridine, dihydropseudouridine, 2-thio-dihydrouridine, 2-thio-dihydropseudouridine, 2-methoxyuridine, 2-methoxy-4-thio-uridine, 4-methoxy-pseudouridine, 4-m ethoxy-2-thio-pseudouridine, 5-aza-cytidine, pseudoisocytidine, 3-methyl-cytidine, N4-acetylcytidine, 5-formylcytidine, N4-methylcytidine, 5-hydroxymethylcytidine, 1-methyl-pseudoisocytidine, pyrrolo-cytidine, pyrrolo-pseudoisocytidine, 2-thio-cytidine, 2-thio-5-methyl-cytidine, 4-thio-pseudoisocytidine, 4-thio-1-methyl-pseudoisocytidine, 4-thio-1- methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, 4-methoxy-1-methyl-pseudoisocytidine, 2-aminopurine, 2, 6-diaminopurine, 7-deaza-adenine, 7-deaza-8-aza-adenine, 7-deaza-2-aminopurine, 7-deaza-8-aza-2-aminopurine, 7-deaza-2,6-diaminopurine, 7-deaza-8-aza-2,6-diaminopurine, 1-methyladenosine, N6-methyladenosine, N6-isopentenyladenosine, N6-(cis-hydroxyisopentenyl)adenosine, 2-methylthio-N6-(cis-hydroxyisopentenyl) adenosine, N6-glycinylcarbamoyladenosine, N6-threonylcarbamoyladenosine, 2-methylthio-N6-threonyl carbamoyladenosine, N6,N6-dimethyladenosine, 7-methyladenine, 2-methylthio-adenine, 2-methoxy-adenine, inosine, 1-methyl-inosine, wyosine, wybutosine, 7-deaza-guanosine, 7-deaza-8-aza-guanosine, 6-thio-guanosine, 6-thio-7-deaza-guanosine, 6-thio-7-deaza-8-aza-guanosine, 7-methyl-guanosine, 6-thio-7-methyl-guanosine, 7-methylinosine, 6-methoxy-guanosine, 1-methylguanosine, N2-methylguanosine, N2,N2-dimethylguanosine, 8-oxo-guanosine, 7-methyl-8-oxo-guanosine, 1-methyl-6-thio-guanosine, N2-methyl-6-thio-guanosine, and N2,N2-dimethyl-6-thio-guanosine. In another embodiment, the modifications are independently selected from the group consisting of 5-methylcytosine, pseudouridine and 1-methylpseudouridine.

In some embodiments, the modified ribonucleosides include 5-methylcytidine, 5-methoxyuridine, 1-methyl-pseudouridine, N6-methyladenosine, and/or pseudouridine. In some embodiments, such modified nucleosides provide additional stability and resistance to immune activation.

In particular embodiments, polynucleotides may be codon-optimized. A codon optimized sequence may be one in which codons in a polynucleotide encoding a polypeptide have been substituted in order to increase the expression, stability and/or activity of the polypeptide. Factors that influence codon optimization include, but are not limited to one or more of: (i) variation of codon biases between two or more organisms or genes or synthetically constructed bias tables, (ii) variation in the degree of codon bias within an organism, gene, or set of genes, (iii) systematic variation of codons including context, (iv) variation of codons according to their decoding tRNAs, (v) variation of codons according to GC %, either overall or in one position of the triplet, (vi) variation in degree of similarity to a reference sequence for example a naturally occurring sequence, (vii) variation in the codon frequency cutoff, (viii) structural properties of mRNAs transcribed from the DNA sequence, (ix) prior knowledge about the function of the DNA sequences upon which design of the codon substitution set is to be based, and/or (x) systematic variation of codon sets for each amino acid. In some embodiments, a codon optimized polynucleotide may minimize ribozyme collisions and/or limit structural interference between the expression sequence and the core functional element.

3. Payloads

In some embodiments, the expression sequence encodes a therapeutic protein. In some embodiments, the therapeutic protein is selected from the proteins listed in the following table.

| Payload | Sequence | SEQ ID NO | Target cell/ organ | Preferred delivery formulation |
|---|---|---|---|---|
| CD19 CAR | Any of sequences 309-314 | | T cells | 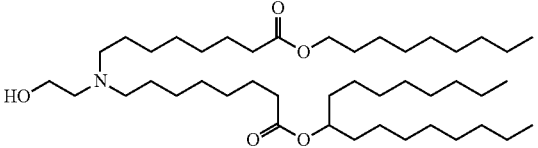 [SMILES: CCCCCCCCCOC(=O)CCCCCCCN(CCO)CCCCCCCC(=O)OC(CCCCCCCC)CCCCCCCC]<br>(50 mol %)<br>DSPC (10 mol %)<br>Beta-sitosterol (28.5% mol %)<br>Cholesterol (10 mol %)<br>PEG DMG (1.5 mol %) |
| BCMA CAR | MALPVTALLLPLALLL HAARPDIVLTQSPASLA VSLGERATINCRASESV SVIGAHLIHWYQQKPG QPPKLLIYLASNLETGV PARFSGSGSGTDFTLTIS SLQAEDAAIYYCLQSRI FPRTFGQGTKLEIKGST SGSGKPGSGEGSTKGQ VQLVQSGSELKKPGAS VKVSCKASGYTFTDYSI NWVRQAPGQGLEWMG WINTETREPAYAYDFR GRFVFSLDTSVSTAYLQ ISSLKAEDTAVYYCAR DYSYAMDYWGQGTLV TVSSAAATTTPAPRPPT PAPTIASQPLSLRPEACR PAAGGAVHTRGLDFAC DIYIWAPLAGTCGVLLL SLVITLYCKRGRKKLLY IFKQPFMRPVQTTQEED | 3668 | T cells | 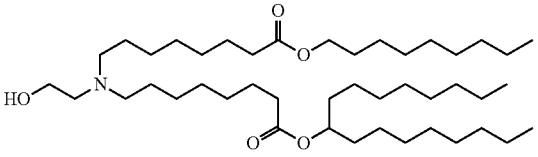 [SMILES: CCCCCCCCCOC(=O)CCCCCCCN(CCO)CCCCCCCC(=O)OC(CCCCCCCC)CCCCCCCC]<br>(50 mol %)<br>DSPC (10 mol %)<br>Beta-sitosterol (28.5% mol %)<br>Cholesterol (10 mol %)<br>PEG DMG (1.5 mol %) |

-continued

| Payload | Sequence | SEQ ID NO | Target cell/ organ | Preferred delivery formulation |
|---|---|---|---|---|
| | GCSCRFPEEEEGGCELR VKFSRSADAPAYQQGQ NQLYNELNLGRREEYD VLDKRRGRDPEMGGKP RRKNPQEGLYNELQKD KMAEAYSEIGMKGERR RGKGHDGLYQGLSTAT KDTYDALHMQALPPR | | | |
| MAGE-A4 TCR | TCR alpha chain: KNQVEQSPQSLIILEGK NCTLQCNYTVSPFSNLR WYKQDTGRGPVSLTIM TFSENTKSNGRYTATLD ADTKQSSLHITASQLSD SASYICVVNHSGGSYIP TFGRGTSLIVHPYIQKP DPAVYQLRDSKSSDKS VCLFTDFDSQTNVSQSK DSDVYITDKTVLDMRS MDFKSNSAVAWSNKS DFACANAFNNSIIPEDT FFPSPESS TCR beta chain: DVKVTQSSRYLVKRTG EKVFLECVQDMDHEN MFWYRQDPGLGLRLIY FSYDVKMKEKGDIPEG YSVSREKKERFSLILES ASTNQTSMYLCASSFL MTSGDPYEQYFGPGTR LTVTEDLKNVFPPEVA VFEPSEAEISHTQKATL VCLATGFYPDHVELSW WVNGKEVHSGVSTDPQ PLKEQPALNDSRYCLSS RLRVSATFWQNPRNHF RCQVQFYGLSENDEWT QDRAKPVTQIVSAEAW GRAD | 3669 and 3670 | T cells | (50 mol %) DSPC (10 mol %) Beta-sitosterol (28.5% mol %) Cholesterol (10 mol %) PEG DMG (1.5 mol %) |
| NY-ESO TCR | TCRalpha extracellular sequence MQEVTQIPAALSVPEGE NLVLNCSFTDSAIYNLQ WFRQDPGKGLTSLLLIQ SSQREQTSGRLNASLDK SSGRSTLYIAASQPGDS ATYLCAVRPTSGGSYIP TFGRGTSLIVHPY TCRbeta extracellular sequence MGVTQTPKFQVLKTGQ SMTLQCAQDMNHEYM SWYRQDPGMGLRLIHY SVGAGITDQGEVPNGY NVSRSTTEDFPLRLLSA APSQTSVYFCASSYVG NTGELFFGEGSRLTVL | 3671 and 3672 | T cells | (50 mol %) DSPC (10 mol %) Beta-sitosterol (28.5% mol %) Cholesterol (10 mol %) PEG DMG (1.5 mol %) |
| EPO | APPRLICDSR VLERYLL EAKEAENITTGCAEHCS LNENITVPDTKVNFYA WKRMEVGQQAVEVW QGLALLSEAVLRGQAL LVNSSQPWEPLQLHVD KAVSGLRSLTTLLRALG AQKEAISPPDAASAAPL RTITADTFRKLFRVYSN FLRGKLKLYTGEACRT GDR | 3673 | Kidney or bone marrow | |

-continued

| Payload | Sequence | SEQ ID NO | Target cell/ organ | Preferred delivery formulation |
|---|---|---|---|---|
| PAH | MSTAVLENPGLGRKLS DFGQETSYIEDNCNQN GAISLIFSLKEEVGALA KVLRLFEENDVNLTHIE SRPSRLKKDEYEFFTHL DKRSLPALTNIIKILRHD IGATVHELSRDKKKDT VPWFPRTIQELDRFANQ ILSYGAELDADHPGFKD PVYRARRKQFADIAYN YRHGQPIPRVEYMEEE KKTWGTVFKTLKSLYK THACYEYNHIFPLLEKY CGFHEDNIPQLEDVSQF LQTCTGFRLRPVAGLLS SRDFLGGLAFRVFHCT QYIRHGSKPMYTPEPDI CHELLGHVPLFSDRSFA QFSQEIGLASLGAPDEY IEKLATIYWFTVEFGLC KQGDSIKAYGAGLLSSF GELQYCLSEKPKLLPLE LEKTAIQNYTVTEFQPL YYVAESFNDAKEKVRN FAATIPRPFSVRYDPYT QRIEVLDNTQQLKILAD SINSEIGILCSALQKIK | 3674 | Hepatic cells | (50 mol %) DSPC (10 mol %) Cholesterol (38.5% mol %) PEG-DMG (1.5%) OR MC3 (50 mol %) DSPC (10 mol %) Cholesterol (38.5% mol %) PEG-DMG (1.5%) |
| CPS1 | LSVKAQTAHIVLEDGT KMKGYSFGHPSSVAGE VVFNTGLGGYPEAITDP AYKGQILTMANPIIGNG GAPDTTALDELGLSKY LESNGIKVSGLLVLDYS KDYNHWLATKSLGQW LQEEKVPAIYGVDTRM LTKIIRDKGTMLGKIEF EGQPVDFVDPNKQNLI AEVSTKDVKVYGKGNP TKVVAVDCGIKNNVIR LLVKRGAEVHLVPWN HDFTKMEYDGILIAGGP GNPALAEPLIQNVRKIL ESDRKEPLFGISTGNLIT GLAAGAKTYKMSMAN RGQNQPVLNITNKQAFI TAQNHGYALDNTLPAG WKPLFVNVNDQTNEGI MHESKPFFAVQFHPEV TPGPIDTEYLFDSFFSLI KKGKATTITSVLPKPAL VASRVEVSKVLILGSGG LSIGQAGEFDYSGSQAV KAMKEENVKTVLMNP NIASVQTNEVGLKQAD TVYFLPITPQFVTEVIKA EQPDGLILGMGGQTAL NCGVELFKRGVLKEYG VKVLGTSVESIMATED ROLFSDKLNEINEKIAPS FAVESIEDALKAADTIG YPVMIRSAYALGGLGS GICPNRETLMDLSTKAF AMTNQILVEKSVTGWK EIEYEVVRDADDNCVT VCNMENVDAMGVHTG DSVVVAPAQTLSNAEF QMLRRTSINVVRHLGIV GECNIQFALHPTSMEYC IIEVNARLSRSSALASK ATGYPLAFIAAKIALGIP LPEIKNVVSGKTSACFE PSLDYMVTKIPRWDLD RFHGTSSRIGSSMKSVG EVMAIGRTFEESFQKAL RMCHPSIEGFTPRLPMN | 3675 | Hepatic cells | (50 mol %) DSPC (10 mol %) Cholesterol (38.5% mol %) PEG-DMG (1.5%) OR MC3 (50 mol %) DSPC (10 mol %) Cholesterol (38.5% mol %) PEG-DMG (1.5%) |

| Payload | Sequence | SEQ ID NO | Target cell/ organ | Preferred delivery formulation |
|---|---|---|---|---|
| | KEWPSNLDLRKELSEPS<br>STRIYAIAKAIDDNMSL<br>DEIEKLTYIDKWFLYK<br>MRDILNMEKTLKGLNS<br>ESMTEETLKRAKEIGFS<br>DKQISKCLGLTEAQTRE<br>LRLKKNIHPWVKQIDTL<br>AAEYPSVTNYLYVTYN<br>GQEHDVNFDDHGMMV<br>LGCGPYHIGSSVEFDW<br>CAVSSIRTLRQLGKKTV<br>VVNCNPETVSTDFDEC<br>DKLYFEELSLERILDIYH<br>QEACGGCIISVGGQIPN<br>NLAVPLYKNGVKIMGT<br>SPLQIDRAEDRSIFSAVL<br>DELKVAQAPWKAVNT<br>LNEALEFAKSVDYPCLL<br>RPSYVLSGSAMNVVFS<br>EDEMKKFLEEATRVSQ<br>EHPVVLTKFVEGAREV<br>EMDAVGKDGRVISHAI<br>SEHVEDAGVHSGDATL<br>MLPTQTISQGAIEKVKD<br>ATRKIAKAFAISGPFNV<br>QFLVKGNDVLVIECNL<br>RASRSFPFVSKTLGVDF<br>IDVATKVMIGENVDEK<br>HLPTLDHPIIPADYVAIK<br>APMFSWPRLRDADPILR<br>CEMASTGEVACFGEGI<br>HTAFLKAMLSTGFKIPQ<br>KGILIGIQQSFRPRFLGV<br>AEQLHNEGFKLFATEA<br>TSDWLNANNVPATPVA<br>WPSQEGQNPSLSSIRKLI<br>RDGSIDLVINLPNNNTK<br>FVHDNYVIRRTAVDSGI<br>PLLTNFQVTKLFAEAV<br>QKSRKVDSKSLFHYRQ<br>YSAGKAA | | | |
| Cas9 | MKRNYILGLDIGITSVG<br>YGIIDYETRDVIDAGVR<br>LFKEANVENNEGRRSK<br>RGARRLKRRRRHRIQR<br>VKKLLFDYNLLTDHSE<br>LSGINPYEARVKGLSQK<br>LSEEEFSAALLHLAKRR<br>GVHNVNEVEEDTGNEL<br>STKEQISRNSKALEEKY<br>VAELQLERLKKDGEVR<br>GSINRFKTSDYVKEAK<br>QLLKVQKAYHQLDQSF<br>IDTYIDLLETRRTYYEG<br>PGEGSPFGWKDIKEWY<br>EMLMGHCTYFPEELRS<br>VKYAYNADLYNALND<br>LNNL VITRDENEKLEYY<br>EKFQIIENVFKQKKKPT<br>LKQIAKEILVNEEDIKG<br>YRVTSTGKPEFTNLKV<br>YHDIKDITARKEIIENAE<br>LLDQIAKILTIYQSSEDI<br>QEELTNLNSELTQEEIE<br>QISNLKGYTGTHNLSLK<br>AINLILDELWHTNDNQI<br>AIFNRLKLVPKKVDLSQ<br>QKEIPTTL VDDFILSPVV<br>KRSFIQSIKVINAIIKKY<br>GLPNDIIIELAREKNSKD<br>AQKMINEMQKRNRQT<br>NERIEEIIRTTGKENAKY<br>LIEKIKLHDMQEGKCLY<br>SLEAIPLEDLLNNPFNY<br>EVDHIIPRSVSFDNSFNN | 3676 | Immune cells | 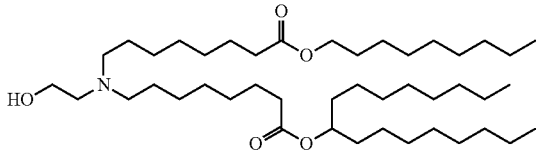 [SMILES: CCCCCCCCCOC(=O)CCCCCCCN(CCO)CCCCCCCC(=O)OC(CCCCCCCC)CCCCCCCC]<br>(50 mol %)<br>DSPC (10 mol %)<br>Beta-sitosterol (28.5% mol %)<br>Cholesterol (10 mol %)<br>PEG DMG (1.5 mol %) |

-continued

| Payload | Sequence | SEQ ID NO | Target cell/ organ | Preferred delivery formulation |
|---|---|---|---|---|
| | KVLVKQEENSKKGNRT PFQYLSSSDSKISYETFK KHILNLAKGKGRISKTK KEYLLEERDINRFSVQK DFINRNLVDTRYATRG LMNLLRSYFRVNNLDV KVKSINGGFTSFLRRK WKFKKERNKGYKHHA EDALIIANADFIFKEWK KLDKAKKVMENQMFE EKQAESMPEIETEQEYK EIFITPHQIKHIKDFKDY KYSHRVDKKPNRELIN DTLYSTRKDDKGNTLI VNNLNGLYDKDNDKL KKLINKSPEKLLMYHH DPQTYQKLKLIMEQYG DEKNPLYKYYEETGNY LTKYSKKDNGPVIKKIK YYGNKLNAHLDITDDY PNSRNKVVKLSLKPYR FDVYLDNGVYKFVTVK NLDVIKKENYYEVNSK CYEEAKKLKKISNQAEF IASFYNNDLIKINGELY RVIGVNNDLLNRIEVN MIDITYREYLENMNDK RPPRIIKTIASKTQSIKK YSTDILGNLYEVKSKK HPQIIKKG | | | |
| ADAM TS13 | AAGGILHLELLVAVGP DVFQAHQEDTERYVLT NLNIGAELLRDPSLGAQ FRVHLVKMVILTEPEG APNITANLTSSLLSVCG WSQTINPEDDTDPGHA DLVLYITRFDLELPDGN RQVRGVTQLGGACSPT WSCLITEDTGFDLGVTI AHEIGHSFGLEHDGAPG SGCGPSGHVMASDGAA SLLSAGRARCVWDPPR PRAGLAWSPCSRRQLL PQPGSAGHPPDAQPGL YYSANEQCRVAFGPKA PLLDGTECGVEKWCSK VACTFAREHLDMCQAL GRCRSLVELTPIAAVHG SCHTDPLDQSSCSRLLV RWSSWGPRSPCSRSCG GGVVTRRRQCNNPRPA FGGRACVGADLQAEM CNTQACEKTQLEFMSQ QCARTDGQPLRSSPGG ASFYHWGAAVPHSQG DALCRHMCRAIGESFIM KRGDSFLDGTRCMPSG PREDGTLSLCVSGSCRT FGCDGRMDSQQVWDR CQVCGGDNSTCSPRKG SFTAGRAREYVTFLTVT PNLTSVYIANHRPLFTH LAVRIGGRYVVAGKMS ISPNTTYPSLLEDGRVE YRVALTEDRLPRLEEIRI WGPLQEDADIQVYRRY GEEYGNLTRPDITFTYF QPKPRQAWVWAAVRG PCSVSCGAGLRWVNYS CLDQARKELVETVQCQ GSQQPPAWPEACVLEP CPPYWAVGDFGPCSAS CGGGLRERPVRCVEAQ GSLLKTLPPARCRAGA QQPAVALETCNPQPCP | 3677 | Hepatic cells | 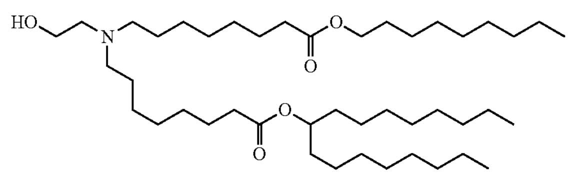 [SMILES: CCCCCCCCCOC(=O)CCCCCCCN(CCO)CCCCCCCC(=O)OC(CCCCCCCC)CCCCCCCC]  (50 mol %) DSPC (10 mol %) Cholesterol (38.5% mol %) PEG-DMG (1.5%) OR MC3 (50 mol %) DSPC (10 mol %) Cholesterol (38.5% mol %) PEG-DMG (1.5%) |

-continued

| Payload | Sequence | SEQ ID NO | Target cell/ organ | Preferred delivery formulation |
|---|---|---|---|---|
| | ARWEVSEPSSCTSAGG AGLALENETCVPGADG LEAPVTEGPGSVDEKLP APEPCVGMSCPPGWGH LDATSAGEKAPSPWGSI RTGAQAAHVWTPAAG SCSVSCGRGLMELRFLC MDSALRVPVQEELCGL ASKPGSRREVCQAVPC PARWQYKLAACSVSCG RGVVRRILYCARAHGE DDGEEILLDTQCQGLPR PEPQEACSLEPCPPRWK VMSLGPCSASCGLGTA RRSVACVQLDQGQDVE VDEAACAALVRPEASV PCLIADCTYRWHVGTW MECSVSCGDGIQRRRD TCLGPQAQAPVPADFC QHLPKPVTVRGCWAGP CVGQGTPSLVPHEEAA APGRTTATPAGASLEW SQARGLLFSPAPQPRRL LPGPQENSVQSSACGR QHLEPTGTIDMRGPGQ ADCAVAIGRPLGEVVT LRVLESSLNCSAGDML LLWGRLTWRKMCRKL LDMTFSSKTNTLVVRQ RCGRPGGGVLLRYGSQ LAPETFYRECDMQLFG PWGEIVSPSLSPATSNA GGCRLFINVAPHARIAI HALATNMGAGTEGAN ASYILIRDTHSLRTTAFH GQQVLYWESESSQAEM EFSEGFLKAQASLRGQ YWTLQSWVPEMQDPQ SWKGKEGT | | | |
| FOXP3 | MPNPRPGKPSAPSLALG PSPGASPSWRAAPKAS DLLGARGPGGTFQGRD LRGGAHASSSSLNPMPP SQLQLPTLPLVMVAPSG ARLGPLPHLQALLQDR PHFMHQLSTVDAHART PVLQVHPLESPAMISLT PPTTATGVFSLKARPGL PPGINVASLEWVSREPA LLCTFPNPSAPRKDSTL SAVPQSSYPLLANGVC KWPGCEKVFEEPEDFL KHCQADHLLDEKGRA QCLLQREMVQSLEQQL VLEKEKLSAMQAHLAG KMALTKASSVASSDKG SCCIVAAGSQGPVVPA WSGPREAPDSLFAVRR HLWGSHGNSTFPEFLH NMDYFKFHNMRPPFTY ATLIRWAILEAPEKQRT LNEIYHWFTRMFAFFR NHPATWKNAIRHNLSL HKCFVRVESEKGAVWT VDELEFRKKRSQRPSRC SNPTPGP | 3678 | Immune cells | 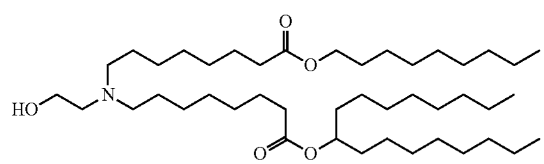 [SMILES: CCCCCCCCCOC(=O)CCCCCCCN(CCO)CCCCCCCC(=O)OC(CCCCCCCC)CCCCCCCC]  (50 mol %) DSPC (10 mol %) Beta-sitosterol (28.5% mol %) Cholesterol (10 mol %) PEG DMG (1.5 mol %) |

| Payload | Sequence | SEQ ID NO | Target cell/organ | Preferred delivery formulation |
|---|---|---|---|---|
| IL-10 | SPGQGTQSENSCTHFPG NLPNMLRDLRDAFSRV KTFFQMKDQLDNLLLK ESLLEDFKGYLGCQALS EMIQFYLEEVMPQAEN QDPDIKAHVNSLGENL KTLRLRLRRCHRFLPCE NKSKAVEQVKNAFNKL QEKGIYKAMSEFDIFIN YIEAYMTMKIRN | 3679 | Immune cells | 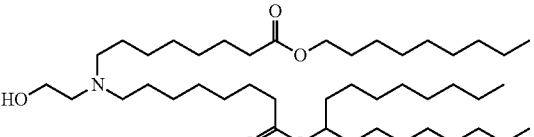<br>(50 mol %)<br>DSPC (10 mol %)<br>Beta-sitosterol (28.5% mol %)<br>Cholesterol (10 mol %)<br>PEG DMG (1.5 mol %) |
| IL-2 | APTSSSTKKTQLQLEHL LLDLQMILNGINNYKNP KLTRMLTFKFYMPKKA TELKHLQCLEEELKPLE EVLNLAQSKNFHLRPR DLISNINVIVLELKGSET TFMCEYADETATIVEFL NRWITFCQSIISTLT | 3680 | Immune cells | 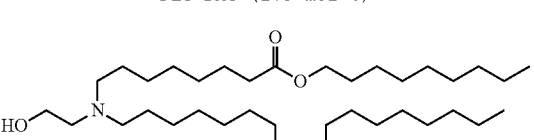<br>(50 mol %)<br>DSPC (10 mol %)<br>Beta-sitosterol (28.5% mol %)<br>Cholesterol (10 mol %)<br>PEG DMG (1.5 mol %) |

In some embodiments, the expression sequence encodes a therapeutic protein. In some embodiments, the expression sequence encodes a cytokine, e.g., IL-12p70, IL-15, IL-2, IL-18, IL-21, IFN-α, IFN-β, IL-10, TGF-beta, IL-4, or IL-35, or a functional fragment thereof. In some embodiments, the expression sequence encodes an immune checkpoint inhibitor. In some embodiments, the expression sequence encodes an agonist (e.g., a TNFR family member such as CD137L, OX40L, ICOSL, LIGHT, or CD70). In some embodiments, the expression sequence encodes a chimeric antigen receptor. In some embodiments, the expression sequence encodes an inhibitory receptor agonist (e.g., PDL1, PDL2, Galectin-9, VISTA, B7H4, or MHCII) or inhibitory receptor (e.g., PD1, CTLA4, TIGIT, LAG3, or TIM3). In some embodiments, the expression sequence encodes an inhibitory receptor antagonist. In some embodiments, the expression sequence encodes one or more TCR chains (alpha and beta chains or gamma and delta chains). In some embodiments, the expression sequence encodes a secreted T cell or immune cell engager (e.g., a bispecific antibody such as BiTE, targeting, e.g., CD3, CD137, or CD28 and a tumor-expressed protein e.g., CD19, CD20, or BCMA etc.). In some embodiments, the expression sequence encodes a transcription factor (e.g., FOXP3, HELIOS, TOX1, or TOX2). In some embodiments, the expression sequence encodes an immunosuppressive enzyme (e.g., IDO or CD39/CD73). In some embodiments, the expression sequence encodes a GvHD (e.g., anti-HLA-A2 CAR-Tregs).

In some embodiments, a polynucleotide encodes a protein that is made up of subunits that are encoded by more than one gene. For example, the protein may be a heterodimer, wherein each chain or subunit of the protein is encoded by a separate gene. It is possible that more than one circRNA molecule is delivered in the transfer vehicle and each circRNA encodes a separate subunit of the protein. Alternatively, a single circRNA may be engineered to encode more than one subunit. In certain embodiments, separate circRNA molecules encoding the individual subunits may be administered in separate transfer vehicles.

A. Antigen-Recognition Receptors a. Chimeric Antigen Receptors (CARS)

Chimeric antigen receptors (CARs or CAR-Ts) are genetically-engineered receptors. These engineered receptors may be inserted into and expressed by immune cells, including T cells via circular RNA as described herein. With a CAR, a single receptor may be programmed to both recognize a specific antigen and, when bound to that antigen, activate the immune cell to attack and destroy the cell bearing that antigen. When these antigens exist on tumor cells, an immune cell that expresses the CAR may target and kill the tumor cell. In some embodiments, the CAR encoded by the polynucleotide comprises (i) an antigen-binding molecule that specifically binds to a target antigen, (ii) a hinge domain, a transmembrane domain, and an intracellular domain, and (iii) an activating domain.

In some embodiments, an orientation of the CARs in accordance with the disclosure comprises an antigen binding domain (such as an scFv) in tandem with a costimulatory domain and an activating domain. The costimulatory domain may comprise one or more of an extracellular portion, a transmembrane portion, and an intracellular portion. In other embodiments, multiple costimulatory domains may be utilized in tandem.

The present invention contemplates the use of such CARs as disclosed, for example, in International Application No. PCT/US2020/034418, in U.S. Provisional Application No. 62/851,548, filed May 22, 2019; U.S. Provisional Patent Application No. 62/857,121, filed Jun. 4, 2019; International Patent Application No. PCT/US2019/035531, filed Jun. 5, 2019, U.S. Provisional Patent Application No. 62/943,796, filed Dec. 4, 2019; U.S. Provisional Patent Application No. 62/943,779, filed Dec. 4, 2019; and U.S. Provisional Patent Application No. 62/972,194, filed Feb. 10, 2020, the teachings of which are incorporated herein by reference in their entirety.

i. Antigen Binding Domain

CARs may be engineered to bind to an antigen (such as a cell-surface antigen) by incorporating an antigen binding molecule that interacts with that targeted antigen. In some embodiments, the antigen binding molecule is an antibody fragment thereof, e.g., one or more single chain antibody fragment (scFv). An scFv is a single chain antibody fragment having the variable regions of the heavy and light chains of an antibody linked together. See U.S. Pat. Nos. 7,741,465, and 6,319,494 as well as Eshhar et al., Cancer Immunol Immunotherapy (1997) 45: 131-136. An scFv retains the parent antibody's ability to specifically interact with target antigen. scFvs are useful in chimeric antigen receptors because they may be engineered to be expressed as part of a single chain along with the other CAR components. Id. See also Krause et al., J. Exp. Med., Volume 188, No. 4, 1998 (619-626); Finney et al., Journal of Immunology, 1998, 161: 2791-2797. It will be appreciated that the antigen binding molecule is typically contained within the extracellular portion of the CAR such that it is capable of recognizing and binding to the antigen of interest. Bispecific and multispecific CARs are contemplated within the scope of the invention, with specificity to more than one target of interest.

In some embodiments, the antigen binding molecule comprises a single chain, wherein the heavy chain variable region and the light chain variable region are connected by a linker. In some embodiments, the VH is located at the N terminus of the linker and the VL is located at the C terminus of the linker. In other embodiments, the VL is located at the N terminus of the linker and the VH is located at the C terminus of the linker. In some embodiments, the linker comprises at least about 5, at least about 8, at least about 10, at least about 13, at least about 15, at least about 18, at least about 20, at least about 25, at least about 30, at least about 35, at least about 40, at least about 45, at least about 50, at least about 60, at least about 70, at least about 80, at least about 90, or at least about 100 amino acids.

In some embodiments, the antigen binding molecule comprises a nanobody. In some embodiments, the antigen binding molecule comprises a DARPin. In some embodiments, the antigen binding molecule comprises an anticalin or other synthetic protein capable of specific binding to target protein.

In some embodiments, the CAR comprises an antigen binding domain specific for an antigen selected from the group CD19, CD123, CD22, CD30, CD171, CS-1, C-type lectin-like molecule-1, CD33, epidermal growth factor receptor variant III (EGFRvIII), ganglioside G2 (GD2), ganglioside GD3, TNF receptor family member B cell maturation (BCMA), Tn antigen ((Tn Ag) or (GaINAca-Ser/Thr)), prostate-specific membrane antigen (PSMA), Receptor tyrosine kinase-like orphan receptor 1 (ROR1), Fms-Like Tyrosine Kinase 3 (FLT3), Tumor-associated glycoprotein 72 (TAG72), CD38, CD44v6, Carcinoembryonic antigen (CEA), Epithelial cell adhesion molecule (EP-CAM), B7H3 (CD276), KIT (CD117), Interleukin-13 receptor subunit alpha-2, mesothelin, Interleukin 11 receptor alpha (IL-11Ra), prostate stem cell antigen (PSCA), Protease Serine 21, vascular endothelial growth factor receptor 2 (VEGFR2), Lewis(Y) antigen, CD24, Platelet-derived growth factor receptor beta (PDGFR-beta), Stage-specific embryonic antigen-4 (SSEA-4), CD20, Folate receptor alpha, HER2, HER3, Mucin 1, cell surface associated (MUC1), epidermal growth factor receptor (EGFR), neural cell adhesion molecule (NCAM), Prostase, prostatic acid phosphatase (PAP), elongation factor 2 mutated (ELF2M), Ephrin B2, fibroblast activation protein alpha (FAP), insulin-like growth factor 1 receptor (IGF-I receptor), carbonic anhydrase IX (CAIX), Proteasome (Prosome, Macropain) Subunit, Beta Type, 9 (LMP2), glycoprotein 100 (gp100), oncogene fusion protein consisting of breakpoint cluster region (BCR) and Abelson murine leukemia viral oncogene homolog 1 (Abl) (bcr-abl), tyrosinase, ephrin type-A receptor 2 (EphA2), Fucosyl GM1, sialyl Lewis adhesion molecule (sLe), ganglioside GM3, transglutaminase 5 (TGS5), high molecular weight-melanoma-associated antigen (HMWMAA), o-acetyl-GD2 ganglioside (OAcGD2), Folate receptor beta, tumor endothelial marker 1 (TEM1/CD248), tumor endothelial marker 7-related (TEM7R), claudin 6 (CLDN6), thyroid stimulating hormone receptor (TSHR), G protein-coupled receptor class C group 5, member D (GPRC5D), chromosome X open reading frame 61 (CXORF61), CD97, CD179a, anaplastic lymphoma kinase (ALK), Polysialic acid, placenta-specific 1 (PLAC1), hexasaccharide portion of globoH glycoceramide (GloboH), mammary gland differentiation antigen (NY-BR-1), uroplakin 2 (UPK2), Hepatitis A virus cellular receptor 1 (HAVCR1), adrenoceptor beta 3 (ADRB3), pannexin 3 (PANX3), G protein-coupled receptor 20 (GPR20), lymphocyte antigen 6 complex, locus K 9 (LY6K), Olfactory receptor 51E2 (OR51E2), TCR Gamma Alternate Reading Frame Protein (TARP), Wilms tumor protein (WT1), Cancer/testis antigen 1 (NY-ESO-1), Cancer/testis antigen 2 (LAGE-1a), MAGE family members (including MAGE-A1, MAGE-A3 and MAGE-A4), ETS translocation-variant gene 6, located on chromosome 12p (ETV6-AML), sperm protein 17 (SPA17), X Antigen Family, Member 1A (XAGE1), angiopoietin-binding cell surface receptor 2 (Tie 2), melanoma cancer testis antigen-1 (MAD-CT-1), melanoma cancer testis antigen-2 (MAD-CT-2), Fos-related antigen 1, tumor protein p53 (p53), p53 mutant, prostein, surviving, telomerase, prostate carcinoma tumor antigen-1, melanoma antigen recognized by T cells 1, Rat sarcoma (Ras) mutant, human Telomerase reverse transcriptase (hTERT), sarcoma translocation breakpoints, melanoma inhibitor of apoptosis (ML-IAP), ERG (transmembrane protease, serine 2 (TM-PRSS2) ETS fusion gene), N-Acetyl glucosaminyl-transferase V (NA17), paired box protein Pax-3 (PAX3), Androgen receptor, Cyclin B1, v-myc avian myelocytomatosis viral oncogene neuroblastoma derived homolog (MYCN), Ras Homolog Family Member C (RhoC), Tyrosinase-related protein 2 (TRP-2), Cytochrome P450 1B1 (CYP1B1), CCCTC-Binding Factor (Zinc Finger Protein)-Like, Squamous Cell Carcinoma Antigen Recognized By T Cells 3 (SART3), Paired box protein Pax-5 (PAX5), proacrosin binding protein sp32 (OY-TES1), lymphocyte-specific protein tyrosine kinase (LCK), A kinase anchor protein 4 (AKAP-4), synovial sarcoma, X breakpoint 2 (SSX2), Receptor for Advanced Glycation Endproducts (RAGE-1), renal ubiquitous 1 (RU1), renal ubiquitous 2 (RU2), legumain, human papilloma virus E6 (HPV E6), human papilloma virus E7 (HPV E7), intestinal carboxyl esterase, heat shock protein 70-2 mutated (mut hsp70-2), CD79a, CD79b, CD72, Leukocyte-associated immunoglobulin-like receptor 1 (LAIR1), Fc fragment of IgA receptor (FCAR or CD89), Leukocyte immunoglobulin-like receptor subfamily A member 2 (LILRA2), CD300 molecule-like family member f (CD300LF), C-type lectin domain family 12 member A (CLEC12A), bone marrow stromal cell antigen 2 (BST2), EGF-like module-containing mucin-like hormone receptor-like 2 (EMR2), lymphocyte antigen 75 (LY75), Glypican-3

(GPC3), Fc receptor-like 5 (FCRL5), MUC16, 5T4, 8H9, αvβ6 integrin, αvβ6 integrin, alphafetoprotein (AFP), B7-H6, ca-125, CA9, CD44, CD44v7/8, CD52, E-cadherin, EMA (epithelial membrane antigen), epithelial glycoprotein-2 (EGP-2), epithelial glycoprotein-40 (EGP-40), ErbB4, epithelial tumor antigen (ETA), folate binding protein (FBP), kinase insert domain receptor (KDR), k-light chain, L1 cell adhesion molecule, MUC18, NKG2D, oncofetal antigen (h5T4), tumor/testis-antigen 1B, GAGE, GAGE-1, BAGE, SCP-1, CTZ9, SAGE, CAGE, CT10, MART-1, immunoglobulin lambda-like polypeptide 1 (IGLL1), Hepatitis B Surface Antigen Binding Protein (HBsAg), viral capsid antigen (VCA), early antigen (EA), EBV nuclear antigen (EBNA), HHV-6 p41 early antigen, HHV-6B U94 latent antigen, HHV-6B p98 late antigen, cytomegalovirus (CMV) antigen, large T antigen, small T antigen, adenovirus antigen, respiratory syncytial virus (RSV) antigen, haemagglutinin (HA), neuraminidase (NA), parainfluenza type 1 antigen, parainfluenza type 2 antigen, parainfluenza type 3 antigen, parainfluenza type 4 antigen, Human Metapneumovirus (HMPV) antigen, hepatitis C virus (HCV) core antigen, HIV p24 antigen, human T-cell lympotrophic virus (HTLV-1) antigen, Merkel cell polyoma virus small T antigen, Merkel cell polyoma virus large T antigen, Kaposi sarcoma-associated herpesvirus (KSHV) lytic nuclear antigen and KSHV latent nuclear antigen. In some embodiments, an antigen binding domain comprises SEQ ID NO: 3547 and/or 3548.

BCMA

B cell mature antigen (BCMA), also known as CD269, is a member of the tumor necrosis factor receptor superfamily, namely TNFRSF17 (Thompson et al., J. Exp. Medicine, 192 (1): 129-135, 2000). Human BCMA is almost exclusively expressed in plasma cells and multiple myeloma cells (see e.g. Novak et al., Blood, 103 (2): 689-694, 2004; Neri et al., Clinical Cancer Research, 73 (19): 5903-5909; Felix et al., Mol. Oncology, 9 (7): 1348-58, 2015). BCMA can bind B-cell activating factor (BAFF) and a proliferation including ligand (APRIL) (e.g. Mackay et al., 2003 and Kalled et al., Immunological Review, 204: 43-54, 2005). BCMA can be a suitable tumor antigen target for immunotherapeutic agents against multiple myeloma. Antibodies of high affinity can block the binding between BCMA and its native ligands BAFF and APRIL.

TABLE 1

Protein sequences of human BCMA

| Position(s) | Description | Length | Amino acid sequence |
|---|---|---|---|
| 1-54 | Extracellular domain | 54 | MLQMAGQCSQNEYFDSLLH ACIPCQLRCSSNTPPLTCQ RYCNASVTNSVKGTNA (SEQ ID NO: 3681) |

TABLE 1-continued

Protein sequences of human BCMA

| Position(s) | Description | Length | Amino acid sequence |
|---|---|---|---|
| 55-77 | Transmembrane domain | 23 | ILWTCLGLSLIISLAVFVL MFLL (SEQ ID NO: 3682) |
| 78-184 | Cytoplasmic domain | 107 | RKINSEPLKDEFKNTGSGL LGMANIDLEKSRTGDEIIL PRGLEYTVEECTCEDCIKS KPKVDSDHCFPLPAMEEGA TILVTTKTNDYCKSLPAAL SATEIEKSISAR (SEQ ID NO: 3683) |

In some embodiments, an anti-BCMA binding moiety specifically binds to an epitope on BCMA derived from an amino acid sequence selected from SEQ ID NOs: 3684-3689.

TABLE 2

BCMA epitope peptide sequences

| Positions | Amino acid sequence | Length |
|---|---|---|
| 1-10 | MLQMAGQCSQ (SEQ ID NO: 3684) | 10 |
| 8-21 | CSQNEYFDSLLHAC (SEQ ID NO: 3685) | 14 |
| 11-23 | NEYFDSLLHACIP (SEQ ID NO: 3686) | 13 |
| 20-30 | ACIPCQLRCSS (SEQ ID NO: 3687) | 11 |
| 24-42 | CQLRCSSNTPPLTCQRYCN (SEQ ID NO: 3688) | 19 |
| 36-43 | LTCQRYCNAS (SEQ ID NO: 3689) | 10 |

In some embodiments, the CAR comprises an antigen binding domain specific for TNF receptor family member B cell maturation (BCMA). In some embodiments, the BCMA antigen-binding domain selectively binds BCMA. In some embodiments, the BCMA antigen-binding domain binds to BCMA on a target cell.

In some embodiments, a BCMA CAR disclosed herein comprises an amino acid sequence having at least about 85%, 86%, 87%, 88%, 89%, 90%, 91%, 92%, 93%>94%>95%>96%, 97%>9800, 9900, or 10000 sequence identity to an amino acid sequence selected from the group consisting of SEQ ID NO: 3690-3695. In some embodiments, the BCMA CAR comprises an amino acid sequence selected from the group consisting of SEQ ID NO: 3690-3695.

(SEQ ID NO: 3690)
MALPVTALLLPLALLLHAARPQVKLEESGGGLVQAGRSLRLSCAASEHTFSSHV

MGWFRQAPGKERESVAVIGWRDISTSYADSVKGRFTISRDNAKKTLYLQMNSLKPEDT

AVYYCAARRIDAADFDSWGQGTQVTVSSGGGGSEVQLVESGGGLVQAGGSLRLSCAA

SGRTFTMGWFRQAPGKEREFVAAISLSPTLAYYAESVKGRFTISRDNAKNTVVLQMNSL

KPEDTALYYCAADRKSVMSIRPDYWGQGTQVTVSSTSTTTPAPRPPTPAPTIASQPLSLR

PEACRPAAGGAVHTRGLDFACDIYIWAPLAGTCGVLLLSLVITLYCKRGRKKLLYIFKQP

-continued

FMRPVQTTQEEDGCSCRFPEEEEGGCELRVKFSRSADAPAYQQGQNQLYNELNLGRRE

EYDVLDKRRGRDPEMGGKPRRKNPQEGLYNELQKDKMAEAYSEIGMKGERRRGKGH

DGLYQGLSTATKDTYDALHMQALPPR (SEQ ID NO: 3691)
MALPVTALLLPLALLLHAARPQVKLEESGGGLVQAGRSLRLSCAASEHTFSSHV

MGWFRQAPGKERESVAVIGWRDISTSYADSVKGRFTISRDNAKKTLYLQMNSLKPEDT

AVYYCAARRIDAADFDSWGQGTQVTVSSGGGGSGGGGSGGGGSEVQLVESGGGLVQA

GGSLRLSCAASGRTFTMGWFRQAPGKEREFVAAISLSPTLAYYAESVKGRFTISRDNAK

NTVVLQMNSLKPEDTALYYCAADRKSVMSIRPDYWGQGTQVTVSSTSTTTPAPRPPTPA

PTIASQPLSLRPEACRPAAGGAVHTRGLDFACDIYIWAPLAGTCGVLLLSLVITLYCKRG

RKKLLYIFKQPFMRPVQTTQEEDGCSCRFPEEEEGGCELRVKFSRSADAPAYQQGQNQL

YNELNLGRREEYDVLDKRRGRDPEMGGKPRRKNPQEGLYNELQKDKMAEAYSEIGMK

GERRRGKGHDGLYQGLSTATKDTYDALHMQALPPR (SEQ ID NO: 3692)
>MALPVTALLLPLALLLHAARPQVKLEESGGGLVQAGRSLRLSCAASEHTFSSH

VMGWFRQAPGKERESVAVIGWRDISTSYADSVKGRFTISRDNAKKTLYLQMNSLKPED

TAVYYCAARRIDAADFDSWGQGTQVTVSSGGGGSGGGGSGGGGSGGGGSGGGGSEVQ

LVESGGGLVQAGGSLRLSCAASGRTFTMGWFRQAPGKEREFVAAISLSPTLAYYAESVK

GRFTISRDNAKNTVVLQMNSLKPEDTALYYCAADRKSVMSIRPDYWGQGTQVTVSSTS

TTTPAPRPPTPAPTIASQPLSLRPEACRPAAGGAVHTRGLDFACDIYIWAPLAGTCGVLLL

SLVITLYCKRGRKKLLYIFKQPFMRPVQTTQEEDGCSCRFPEEEEGGCELRVKFSRSADA

PAYQQGQNQLYNELNLGRREEYDVLDKRRGRDPEMGGKPRRKNPQEGLYNELQKDK

MAEAYSEIGMKGERRRGKGHDGLYQGLSTATKDTYDALHMQALPPR (SEQ ID NO: 3693)
MALPVTALLLPLALLLHAARPEVQLVESGGGLVQAGGSLRLSCAASGRTFTMG

WFRQAPGKEREFVAAISLSPTLAYYAESVKGRFTISRDNAKNTVVLQMNSLKPEDTALY

YCAADRKSVMSIRPDYWGQGTQVTVSSGGGGSGGGGSQVKLEESGGGLVQAGRSLRL

SCAASEHTFSSHVMGWFRQAPGKERESVAVIGWRDISTSYADSVKGRFTISRDNAKKTL

YLQMNSLKPEDTAVYYCAARRIDAADFDSWGQGTQVTVSSTSTTTPAPRPPTPAPTIAS

QPLSLRPEACRPAAGGAVHTRGLDFACDIYIWAPLAGTCGVLLLSLVITLYCKRGRKKL

LYIFKQPFMRPVQTTQEEDGCSCRFPEEEEGGCELRVKFSRSADAPAYQQGQNQLYNEL

NLGRREEYDVLDKRRGRDPEMGGKPRRKNPQEGLYNELQKDKMAEAYSEIGMKGERR

RGKGHDGLYQGLSTATKDTYDALHMQALPPR (SEQ ID NO: 3694)
MALPVTALLLPLALLLHAARPEVQLVESGGGLVQAGGSLRLSCAASGRTFTMG

WFRQAPGKEREFVAAISLSPTLAYYAESVKGRFTISRDNAKNTVVLQMNSLKPEDTALY

YCAADRKSVMSIRPDYWGQGTQVTVSSGGGGSGGGGSGGGGSQVKLEESGGGLVQAG

RSLRLSCAASEHTFSSHVMGWFRQAPGKERESVAVIGWRDISTSYADSVKGRFTISRDN

AKKTLYLQMNSLKPEDTAVYYCAARRIDAADFDSWGQGTQVTVSSTSTTTPAPRPPTPA

PTIASQPLSLRPEACRPAAGGAVHTRGLDFACDIYIWAPLAGTCGVLLLSLVITLYCKRG

RKKLLYIFKQPFMRPVQTTQEEDGCSCRFPEEEEGGCELRVKFSRSADAPAYQQGQNQL

```
YNELNLGRREEYDVLDKRRGRDPEMGGKPRRKNPQEGLYNELQKDKMAEAYSEIGMK

GERRRGKGHDGLYQGLSTATKDTYDALHMQALPPR (SEQ ID NO: 3695)
MALPVTALLLPLALLLHAARPEVQLVESGGGLVQAGGSLRLSCAASGRTFTMG

WFRQAPGKEREFVAAISLSPTLAYYAESVKGRFTISRDNAKNTVVLQMNSLKPEDTALY

YCAADRKSVMSIRPDYWGQGTQVTVSSGGGGSGGGGSGGGGSGGGGSQVKLEESGGG

LVQAGRSLRLSCAASEHTFSSHVMGWFRQAPGKERESVAVIGWRDISTSYADSVKGRFT

ISRDNAKKTLYLQMNSLKPEDTAVYYCAARRIDAADFDSWGQGTQVTVSSTSTTTPAPR

PPTPAPTIASQPLSLRPEACRPAAGGAVHTRGLDFACDIYIWAPLAGTCGVLLLSLVITLY

CKRGRKKLLYIFKQPFMRPVQTTQEEDGCSCRFPEEEEGGCELRVKFSRSADAPAYQQG

QNQLYNELNLGRREEYDVLDKRRGRDPEMGGKPRRKNPQEGLYNELQKDKMAEAYSE

IGMKGERRRGKGHDGLYQGLSTATKDTYDALHMQALPPR
```

In some embodiments, a BCMA CAR disclosed herein comprises an amino acid sequence having at least about 85%, 86%, 87%, 88%, 89%, 90%, 91%, 92%, 93%, 94%, 95%, 96%, 97%, 9800, 9900, or 1000% sequence identity to an amino acid sequence selected from the group consisting of SEQ ID NO: 338-417. In some embodiments, a BCMA CAR comprises an amino acid sequence selected from the group consisting of SEQ ID NOs: 3696-3775.

TABLE 3

Exemplary BCMA sequences

| SEQ ID NO: | Amino acid sequence |
|---|---|
| 3696 | QVQLVESGGGLVQPGGSLRLSCEASGFTLDYYAIGWFRQAPGKERE GVICISRSDGSTYYADSVKGRFTISRDNAKKTVYLQMISLKPEDTAAY YCAAGADCSGYLRDYEFRGQGTQVTVSS |
| 3697 | QVKLEESGGRLVQPRGSLRLSCAGSGRTFSTYGMAWFRQAPGKERE FVASKASMNYSGRTYYADSVKGRFTIARDNAKNMVFLQMNNLKPE DTAVYYCAAGTGCSTYGCFDAQIIDYWGKGTLVTVSS |
| 3698 | EVQLVESGGGLVQAGGSLRLSCAASGRTFTMGWFRQAPGKEREFVA AISLSPTLAYYAESVKGRFTISRDNAKNTVVLQMNSLKPEDTALYYC AADRKSVMSIRPDYWGQGTQVTVSS |
| 3699 | AVQLVDSGGGLVQPGGSLRLSCVASGGIFVINAMGWYRQAPGKQRE LVASIRGLGRTNYDDSVKGRFTISRDNANNTVYLQMNSLEPEDTAV YYCTVYVTLLGGVNRDYWGQGTQVTVSS |
| 3700 | EVQLVESGGGLVQAGGSLRLSCAASGRTFSSIVMGWFRQAPGKERE FVGAIMWNDGITYLQDSVKGRFTIFRDNAKNTVYLQMNSLKLEDTA VYYCAASKGRYSEYEYWGQGTQVTVSS |
| 3701 | EVQLVESGGGVVQAGGSLTVSCTASGFTFDRAVIVWFRQAPGKGRE GVSFIKPSDGTIYYIDSLKGRFTISSDIAKNTVYLQMKSLESEDSAVYY CAASPEDWYTDWIDWSIYRWQHWGQGTQVTVSS |
| 3702 | EVQLVESGGGMVQAGDSLRLSCVQSTYTVNSDVMGWFRQAPGKER EFVGAIMWNDGITYLQDSVKGRFTIFRDNAKNTVYLQMNSLKLEDT AVYYCAASKGRYSEYEYWGQGTQVTVSS |
| 3703 | AVQLVESGGGLVQAGDSLRLSCTASGATLINDHMAWFRQAPGKGR EFVAAIDWSGRTTNYADPVEGRFTISRNNAKNTVYLEMNSLKLEDT AVYYCAVLRAWISYDNDYWGQGTQVTVSS |
| 3704 | QVQLVESGGGLVQAGGSLRLSCAASGGTLSKNTVAWFRQAPGKER GFVASITWDGRTTYYADSVKGRFTISRDNAKNTVYLQMNSLKPEDT AVYVCADLGKWPAGPADYWGQGTQVTVSS |
| 3705 | QVKLEESGGGLVQAGRSLRLSCAASEHTFSSHVMGWFRQAPGKERE SVAVIGWRDISTSYADSVKGRFTISRDNAKKTLYLQMNSLKPEDTAV YYCAARRIDAADFDSWGQGTQVTVSS |
| 3706 | AVQLVESGGGLVQAGDSLRLTCTASGRAFSTYFMAWFRQAPGKERE FVAGIAWSGGSTAYADSVKGRFTISRDNAKNTVYLQMNSLKSEDTA VYYCASRGIEVEEFGAWGQGTQVTVSS |

TABLE 3-continued

Exemplary BCMA sequences

| SEQ ID NO: | Amino acid sequence |
|---|---|
| 3707 | QVQLVESGGGLVQPGGSLRLSCEASGFTLDYYAIGWFRQAPGKERE<br>GVICISRSDGSTYYADSVKGRFTISRDNAKKTVYLQMISLKPEDTAAY<br>YCAAGADCSGYLRDYEFRGQGTQVTVSS |
| 3708 | QVKLEESGGGLVQAGRSLRLSCAASEHTFSSHVMGWFRQAPGKERE<br>SVAVIGWRDISTSYADSVKGRFTISRDNAKKTLYLQMNSLKPEDTAV<br>YYCAARRIDAADFDSWGQGTQVTVSS |
| 3709 | EVQLVESGGGLVQAGGSLRLSCAASGRTFTMGWFRQAPGKEREFVA<br>AISLSPTLAYYAESVKGRFTISRDNAKNTVVLQMNSLKPEDTALYYC<br>AADRKSVMSIRPDYWGQGTQVTVSS |
| 3710 | EVQLVESGGGLVPPGGSLRLSCTASGSTVSINVMAWYRQVSGKQRE<br>LVAAVTRDGRKSCGDSVKGRFTISRDGAKNAVYLQMNSLKPEDTAV<br>YLCGADGWGATTLDYTYGMDYWGKGTQVTVSS |
| 3711 | AVQLVESGGGLVQAGGSLRLSCAASGRTFTMGWFRQAPGKERGFV<br>ASITWDGRSAYYAESVKGRFTISRDNAKNTVVLQMNSLKPEDTALY<br>YCAADRKSVMSIRPDYWGQGTQVTVSS |
| 3712 | QVQLVESGGGLVQPGGSLRLACEAPGSGNSINAMGWYRQTPGKRRE<br>LVATITRGGSTNYGPSVKGRFTITRDNVKNTVHLQMNSLKPDDTAV<br>YYCNAERLDGSGYGYEYDYWGQGTQVTVSS |
| 3713 | QVKLEESGGGLVQAGGSLRLSCAASGGTLSKNTVAWVRQAPGKER<br>GFVTSITCDGRTTYYANSVNGRFPINRNNAENLVVLQMNSLKPDDTA<br>LYYCAAYRKSIMSIQPDYWGQGTQVTVSS |
| 3714 | DVQLVESGGGLVQAGGSLRLSCAASGRTFSSIVMGWFRQAPGKERE<br>FVGAIMWNDGLTYLQGSVKGRFTISRDNAKNTVVLQMNSLKPEDTA<br>LYYCAADRKSVMSIRPDYWGQGTQVTVSS |
| 3715 | QVQLVESGGGLVQAGGSLRLSCAASGRTFTMGWFRQAPGKEREFV<br>AAISLSPTLAYYAESVKGRFTISRDNAKNTVVLQMNSLKPEDTAVYY<br>CAARRIDAADFDSWGQGTQVTVSS |
| 3716 | QVQLVESGGGLVQAGGSLRLSCAASGGTLSKNTVAWFRQAPGKER<br>GFVASITWDGRTTYYADSVKGRFTISRDNAKNTVYLQMNSLKPEDT<br>AVYVCADLGKWPAGPADYWGQGTQVTVSS |
| 3717 | QVQLVESGGGLVQPGGSLTLSCAASGSIDSINTMDWFRQAPGKEREF<br>VAAISLSPTLAYYAESVKGRFTISRDNAKNTVVLQMNSLKPEDTALY<br>YCAADRKSVMSIRPDYWGQGTQVTVSS |
| 3718 | DVQLVESGGGLVQAGGSLRLSCAASGGTLSKNTVAWVRQAPGKER<br>GFVTSITCDGRTTYYANSVKGRFPISRDNAENTVYLQMNSLKPEDTA<br>GYVCADLGKWPAGSADYWGQGTHVTVSS |
| 3719 | QVKLEESGGGLVQPGGSLRLSCTASEFTFSDYWMHWVRQAPGKGLE<br>WVASIDTSGQTTYYADSLKGRFTISRDNAKSTLYLQMNSLKSEDTGV<br>YFCAKRYRGGTWYGMANWGKGTQVTVSS |
| 3720 | QVQLVESGGGLVQAGGSLRLSCAASGRTLSSNTMAWFRQAPGKERE<br>FVASTTWNGRSTYYADSVKGRFTISRDNAKNTMYLQMNSLKPEDTA<br>VYYCADLGKWPAGPADYWGQGTQVTVSS |
| 3721 | QVQLVESGGGLVQAGGSLRLSCAASGRTFTMGWFRQAPGKQRELV<br>ADISGGRTNYADSVKGRFTISRDNAKNTVYLQMNSLKPEDTAVYYC<br>AADRKSVMSIRPDYWGQGTQVTVSS |
| 3722 | QVQLVESGGGLVQAGASLRLSCAASGRTFTVAAISLSPTLAYYAESV<br>KGRFTISRDNAKNTVVLQMNSLKPEDTALYYCAADRKSVMSIRPDY<br>WGQGTQVTVSS |
| 3723 | DVQLVESGGGLEQAGGSLRLSCAASGGTLSKNTVAWFRQAPGKERG<br>FVASITWDGRTTYYADSVKGRFTISRDNAKNTVYLQMNSLKPEDTA<br>VYYCASTASCHLFGLGSGAFVSWGRGTQVTVSS |
| 3724 | AVQLVESGGGLVQAGGSLRLSCAASGRTFTMGWFHQAPGKEREFV<br>AAISLSPTLAYYAESVKGRFTISRDNAKNTVVLQMNSLKPEDTALYY<br>CAASKDRYSEYEYWGQGTQVTVSS |
| 3725 | QVKLEESGGGLVQAGGSLRLSCAASGRTFTMGWFRQAPGKEREFVA<br>AISLSPTLAYYAESVKGRFTISRDNAKNTVVLQMNSLKPEDTALYYC<br>AKKNGGPVDYWGKGTQVTVSS |

TABLE 3-continued

Exemplary BCMA sequences

| SEQ ID NO: | Amino acid sequence |
|---|---|
| 3726 | DVQLVESGGGLVQPGGSLRLSCAASGRTFSSIVMGWFRQAPGKEREF VGAIMWNDGITYLQDSVKGRFTIFRDNAKNTVYLQMNSLKLEDTAV YYCAASKGRYSEYEYWGQGTQVTVSS |
| 3727 | QVKLEESGGRLVQAGGSLKLSWAASGRTFTMGWFRQAPGKEREFV TAINLSPTLTYYAESVKGRFPISRNNAQNTVVLQMNSLKPEDTALYY CAAERKSVMAIPPDYWGQGTQVTVSS |
| 3728 | QVKLEESGGRLVQAGGSLKLSWAASGRTFTMGWFRQAPGKEREFV TAINLSPTLTYYAESVKGRFPISRNNAQNTVVLQMNSLKPEDTALYY CAAERKSVMAIPPDYWGQGTQVTVSS |
| 3729 | EVQLVESGGGLVQAGGSLRLSCAASGRTFTMGGFRR VPRDEREFVA SITLIPTFPYYAYSVKGRFALFRDNPNNTVILLMISLKPEDPDLYYCAS YRKYLMSILPDYWGQGTQGTVSS |
| 3730 | QVKLEESGGGLVQAGGSLRLSCAASGRTFTMGWFRQAPGKEREFVA AISLSPTLAYYAESVKGRFTISRDNAKNTVDLQMNSLKPEDTAVYFC AANRNSQRVIAALSWIGMNYWGEWTQVTVSS |
| 3731 | QVQLVESGGGLVQAGGSLRLSCAASGRTFTMGWFRQAPGKEREFV AAISLSPTLAYYAESVKGRFTISRDNAKKTLYLRMNSLKPEDTAVYY CAARRIDAADFDSWGQGTQVTVSS |
| 3732 | QVKLEESGGGLVQAGGSLRLSCAASGRTFTMGWFRRAPGKERESVA VIGWRDINASYADSVKGRFAISRDNAKKTLYLQMNSLKPEDTAVYY CAARRIDATDFDSWGQGTQVTVSS |
| 3733 | QVKLEESGGGLVQTGGSLRLSCAASEHTFSNHVMGWFRQAPGKERE SVAVIGWRDISTSYADSVKGRFTISRDNAKKTLYLQMNSLKPEDTAV YYCAARRIDAADFDSRGQGTQVTVSS |
| 3734 | AVQLVDSGGGLVQAGGSLRISCAVSGRTSSNYILAWFRQAPGKERDF VAHISRSGGKSGYGDSVKGRFTISRDNAENTVRVYLQMNSLKPGDT AVYYCNRPLWYGSPTLIDYWGQGTQVTVSS |
| 3735 | QVQLVESGGGLVQAGGSLRLSCAASGRTFTMGWFRQAPGKEREFV AAISLSPTLAYYAESVKGRFTISRDNAKNTVVLQMNSLKPEDTALYY CAADRKSVMSIRPDYWGQGTQVTVSS |
| 3736 | AVQLVDSGGGLVQAGGSLRLSCAASGRTFTMGWFRQAPGKEREFV AAISLSPTLAYYAEPVKGRFTISRDNAKNTVVLQMNSLKPEDTALYY CAADRKSVMSIRPDYWGQGTQVTVSS |
| 3737 | DVQLVESGGGSVQTGGSLRLSCTASGRTLNNFVMGWFRQAPGKERE FVAAISLSPTLAYYVESVKGRFTISRDNAKNTVVLQMNSLKPEDTAL YYCAADRKSVMSIRPDYWGQGTQVTVSS |
| 3738 | APGKEREGVICISRSDGSTYYADSVKGRFTISRDNAKKTVYLQMISLK PEDTAAYYCAAGADCSGYLRDYEFRGQGTQVTVSSGGGGSQVQLV ESGGGLVQPGGSLRLSCEASGFTLDYYAIGWFRQAPGKEREGVICISR SDGSTYYADSVKGRFTISRDNAKKTVYLQMISLKPEDTAAYYCAAG ADCSGYLRDYEFRGQGTQVTVSS |
| 3739 | QVQLVESGGGLVQPGGSLRLSCEASGFTLDYYAIGWFRQAPGKERE GVICISRSDGSTYYADSVKGRFTISRDNAKKTVYLQMISLKPEDTAAY YCAAGADCSGYLRDYEFRGQGTQVTVSSGGGGSQVQLVESGGGLV QPGGSLRLSCEASGFTLDYYAIGWFRQAPGKEREGVICISRSDGSTYY ADSVKGRFTISRDNAKKTVYLQMISLKPEDTAAYYCAAGADCSGYL RDYEFRGQGTQVTVSSGGGGSQVQLVESGGGLVQPGGSLRLSCEAS GFTLDYYAIGWFRQAPGKEREGVICISRSDGSTYYADSVKGRFTISRD NAKKTVYLQMISLKPEDTAAYYCAAGADCSGYLRDYEFRGQGTQV TVSS |
| 3740 | QVKLEESGGGLVQAGRSLRLSCAASEHTFSSHVMGWFRQAPGKERE SVAVIGWRDISTSYADSVKGRFTISRDNAKKTLYLQMNSLKPEDTAV YYCAARRIDAADFDSWGQGTQVTVSSGGGGSEVQLVESGGGLVQA GGSLRLSCAASGRTFTMGWFRQAPGKEREFVAAISLSPTLAYYAESV KGRFTISRDNAKNTVVLQMNSLKPEDTALYYCAADRKSVMSIRPDY WGQGTQVTVSS |
| 3741 | QVKLEESGGGLVQAGRSLRLSCAASEHTFSSHVMGWFRQAPGKERE SVAVIGWRDISTSYADSVKGRFTISRDNAKKTLYLQMNSLKPEDTAV YYCAARRIDAADFDSWGQGTQVTVSSGGGGSGGGGSGGGGSEVQL VESGGGLVQAGGSLRLSCAASGRTFTMGWFRQAPGKEREFVAAISL |

TABLE 3-continued

Exemplary BCMA sequences

| SEQ ID NO: | Amino acid sequence |
|---|---|
| | SPTLAYYAESVKGRFTISRDNAKNTVVLQMNSLKPEDTALYYCAAD<br>RKSVMSIRPDYWGQGTQVTVSS |
| 3742 | QVKLEESGGGLVQAGRSLRLSCAASEHTFSSHVMGWFRQAPGKERE<br>SVAVIGWRDISTSYADSVKGRFTISRDNAKKTLYLQMNSLKPEDTAV<br>YYCAARRIDAADFDSWGQGTQVTVSSGGGGSGGGGSGGGGSGGGG<br>SGGGGSEVQLVESGGGLVQAGGSLRLSCAASGRTFTMGWFRQAPG<br>KEREFVAAISLSPTLAYYAESVKGRFTISRDNAKNTVVLQMNSLKPE<br>DTALYYCAADRKSVMSIRPDYWGQGTQVTVSS |
| 3743 | EVQLVESGGGLVQAGGSLRLSCAASGRTFTMGWFRQAPGKEREFVA<br>AISLSPTLAYYAESVKGRFTISRDNAKNTVVLQMNSLKPEDTALYYC<br>AADRKSVMSIRPDYWGQGTQVTVSSGGGGSGGGGSGGGSQVKLEESGGG<br>LVQAGRSLRLSCAASEHTFSSHVMGWFRQAPGKERESVAVIGWRDI<br>STSYADSVKGRFTISRDNAKKTLYLQMNSLKPEDTAVYYCAARRID<br>AADFDSWGQGTQVTVSS |
| 3744 | EVQLVESGGGLVQAGGSLRLSCAASGRTFTMGWFRQAPGKEREFVA<br>AISLSPTLAYYAESVKGRFTISRDNAKNTVVLQMNSLKPEDTALYYC<br>AADRKSVMSIRPDYWGQGTQVTVSSGGGGSGGGGSGGGGSQVKLE<br>ESGGGLVQAGRSLRLSCAASEHTFSSHVMGWFRQAPGKERESVAVI<br>GWRDISTSYADSVKGRFTISRDNAKKTLYLQMNSLKPEDTAVYYCA<br>ARRIDAADFDSWGQGTQVTVSS |
| 3745 | EVQLVESGGGLVQAGGSLRLSCAASGRTFTMGWFRQAPGKEREFVA<br>AISLSPTLAYYAESVKGRFTISRDNAKNTVVLQMNSLKPEDTALYYC<br>AADRKSVMSIRPDYWGQGTQVTVSSGGGGSGGGGSGGGGSGGGGS<br>QVKLEESGGGLVQAGRSLRLSCAASEHTFSSHVMGWFRQAPGKERE<br>SVAVIGWRDISTSYADSVKGRFTISRDNAKKTLYLQMNSLKPEDTAV<br>YYCAARRIDAADFDSWGQGTQVTVSS |
| 3746 | QVKLEESGGGLVQAGRSLRLSCAASEHTFSSHVMGWFRQAPGKERE<br>SVAVIGWRDISTSYADSVKGRFTISRDNAKKTLYLQMNSLKPEDTAV<br>YYCAARRIDAADFDSWGQGTQVTVSSGGGGSAVQLVESGGGLVQA<br>GDSLRLTCTASGRAFSTYFMAWFRQAPGKEREFVAGIAWSGGSTAY<br>ADSVKGRFTISRDNAKNTVYLQMNSLKSEDTAVYYCASRGIEVEEFG<br>AWGQGTQVTVSS |
| 3747 | QVKLEESGGGLVQAGRSLRLSCAASEHTFSSHVMGWFRQAPGKERE<br>SVAVIGWRDISTSYADSVKGRFTISRDNAKKTLYLQMNSLKPEDTAV<br>YYCAARRIDAADFDSWGQGTQVTVSSGGGGSGGGGSGGGGSAVQL<br>VESGGGLVQAGDSLRLTCTASGRAFSTYFMAWFRQAPGKEREFVAG<br>IAWSGGSTAYADSVKGRFTISRDNAKNTVYLQMNSLKSEDTAVYYC<br>ASRGIEVEEFGAWGQGTQVTVSS |
| 3748 | QVKLEESGGGLVQAGRSLRLSCAASEHTFSSHVMGWFRQAPGKERE<br>SVAVIGWRDISTSYADSVKGRFTISRDNAKKTLYLQMNSLKPEDTAV<br>YYCAARRIDAADFDSWGQGTQVTVSSGGGGSGGGGSGGGGSGGGG<br>SGGGGSAVQLVESGGGLVQAGDSLRLTCTASGRAFSTYFMAWFRQ<br>APGKEREFVAGIAWSGGSTAYADSVKGRFTISRDNAKNTVYLQMNS<br>LKSEDTAVYYCASRGIEVEEFGAWGQGTQVTVSS |
| 3749 | AVQLVESGGGLVQAGDSLRLTCTASGRAFSTYFMAWFRQAPGKERE<br>FVAGIAWSGGSTAYADSVKGRFTISRDNAKNTVYLQMNSLKSEDTA<br>VYYCASRGIEVEEFGAWGQGTQVTVSSGGGGSGGGGSQVKLEESGG<br>GLVQAGRSLRLSCAASEHTFSSHVMGWFRQAPGKERESVAVIGWRD<br>ISTSYADSVKGRFTISRDNAKKTLYLQMNSLKPEDTAVYYCAARRID<br>AADFDSWGQGTQVTVSS |
| 3750 | AVQLVESGGGLVQAGDSLRLTCTASGRAFSTYFMAWFRQAPGKERE<br>FVAGIAWSGGSTAYADSVKGRFTISRDNAKNTVYLQMNSLKSEDTA<br>VYYCASRGIEVEEFGAWGQGTQVTVSSGGGGSGGGGSGGGGSQVK<br>LEESGGGLVQAGRSLRLSCAASEHTFSSHVMGWFRQAPGKERESVA<br>VIGWRDISTSYADSVKGRFTISRDNAKKTLYLQMNSLKPEDTAVYYC<br>AARRIDAADFDSWGQGTQVTVSS |
| 3751 | APGKEREFVAGIAWSGGSTAYADSVKGRFTISRDNAKNTVYLQMNS<br>LKSEDTAVYYCASRGIEVEEFGAWGQGTQVTVSSGGGGSGGGGSGG<br>GGSGGGGSQVKLEESGGGLVQAGRSLRLSCAASEHTFSSHVMGWFR<br>QAPGKERESVAVIGWRDISTSYADSVKGRFTISRDNAKKTLYLQMNS<br>LKPEDTAVYYCAARRIDAADFDSWGQGTQVTVSS |
| 3752 | EVQLVESGGGMVQAGDSLRLSCVQSTYTVNSDVMGWFRQAPGKER<br>EFVGAIMWNDGITYLQDSVKGRFTIFRDNAKNTVYLQMNSLKLEDT<br>AVYYCAASKGRYSEYEYWGQGTQVTVSSGGGGSQVKLEESGGRLV<br>QPRGSLRLSCAGSGRTFSTYGMAWFRQAPGKEREFVASKASMNYSG |

TABLE 3-continued

Exemplary BCMA sequences

| SEQ ID NO: | Amino acid sequence |
|---|---|
| | RTYYADSVKGRFTIARDNAKNMVFLQMNNLKPEDTAVYYCAAGTG<br>CSTYGCFDAQIIDYWGKGTLVTVSS |
| 3753 | EVQLVESGGGMVQAGDSLRLSCVQSTYTVNSDVMGWFRQAPGKER<br>EFVGAIMWNDGITYLQDSVKGRFTIFRDNAKNTVYLQMNSLKLEDT<br>AVYYCAASKGRYSEYEYWGQGTQVTVSSGGGGSGGGGSGGGGSQ<br>VKLEESGGRLVQPRGSLRLSCAGSGRTFSTYGMAWFRQAPGKEREF<br>VASKASMNYSGRTYYADSVKGRFTIARDNAKNMVFLQMNNLKPED<br>TAVYYCAAGTGCSTYGCFDAQIIDYWGKGTLVTVSS |
| 3754 | EVQLVESGGGMVQAGDSLRLSCVQSTYTVNSDVMGWFRQAPGKER<br>EFVGAIMWNDGITYLQDSVKGRFTIFRDNAKNTVYLQMNSLKLEDT<br>AVYYCAASKGRYSEYEYWGQGTQVTVSSGGGGSGGGGSGGGGSG<br>GGGSGGGGSQVKLEESGGRLVQPRGSLRLSCAGSGRTFSTYGMAWF<br>RQAPGKEREFVASKASMNYSGRTYYADSVKGRFTIARDNAKNMVF<br>LQMNNLKPEDTAVYYCAAGTGCSTYGCFDAQIIDYWGKGTLVTVSS |
| 3755 | EVQLVESGGGMVQAGDSLRLSCVQSTYTVNSDVMGWFRQAPGKER<br>EFVGAIMWNDGITYLQDSVKGRFTIFRDNAKNTVYLQMNSLKLEDT<br>AVYYCAASKGRYSEYEYWGQGTQVTVSSGGGGSGGGGSQVKLEES<br>GGRLVQPRGSLRLSCAGSGRTFSTYGMAWFRQAPGKEREFVASKAS<br>MNYSGRTYYADSVKGRFTIARDNAKNMVFLQMNNLKPEDTAVYYC<br>AAGTGCSTYGCFDAQIIDYWGKGTLVTVSS |
| 3756 | EVQLVESGGGMVQAGDSLRLSCVQSTYTVNSDVMGWFRQAPGKER<br>EFVGAIMWNDGITYLQDSVKGRFTIFRDNAKNTVYLQMNSLKLEDT<br>AVYYCAASKGRYSEYEYWGQGTQVTVSSGGGGSGGGGSGGGGSQ<br>VKLEESGGRLVQPRGSLRLSCAGSGRTFSTYGMAWFRQAPGKEREF<br>VASKASMNYSGRTYYADSVKGRFTIARDNAKNMVFLQMNNLKPED<br>TAVYYCAAGTGCSTYGCFDAQIIDYWGKGTLVTVSS |
| 3757 | EVQLVESGGGMVQAGDSLRLSCVQSTYTVNSDVMGWFRQAPGKER<br>EFVGAIMWNDGITYLQDSVKGRFTIFRDNAKNTVYLQMNSLKLEDT<br>AVYYCAASKGRYSEYEYWGQGTQVTVSSGGGGSGGGGSGGGGSG<br>GGGSQVKLEESGGRLVQPRGSLRLSCAGSGRTFSTYGMAWFRQAPG<br>KEREFVASKASMNYSGRTYYADSVKGRFTIARDNAKNMVFLQMNN<br>LKPEDTAVYYCAAGTGCSTYGCFDAQIIDYWGKGTLVTVSS |
| 3758 | QVKLEESGGRLVQPRGSLRLSCAGSGRTFSTYGMAWFRQAPGKERE<br>FVASKASMNYSGRTYYADSVKGRFTIARDNAKNMVFLQMNNLKPE<br>DTAVYYCAAGTGCSTYGCFDAQIIDYWGKGTLVTVSSGGGGSQVKL<br>EESGGGLVQAGGSLRLSCAASGGTLSKNTVAWVRQAPGKERGFVTS<br>ITCDGRTTYYANSVNGRFPINRNNAENLVVLQMNSLKPDDTALYYC<br>AAYRKSIMSIQPDYWGQGTQVTVSS |
| 3759 | QVKLEESGGRLVQPRGSLRLSCAGSGRTFSTYGMAWFRQAPGKERE<br>FVASKASMNYSGRTYYADSVKGRFTIARDNAKNMVFLQMNNLKPE<br>DTAVYYCAAGTGCSTYGCFDAQIIDYWGKGTLVTVSSGGGGSGGG<br>GSGGGGSQVKLEESGGGLVQAGGSLRLSCAASGGTLSKNTVAWVR<br>QAPGKERGFVTSITCDGRTTYYANSVNGRFPINRNNAENLVVLQMN<br>SLKPDDTALYYCAAYRKSIMSIQPDYWGQGTQVTVSS |
| 3760 | QVKLEESGGRLVQPRGSLRLSCAGSGRTFSTYGMAWFRQAPGKERE<br>FVASKASMNYSGRTYYADSVKGRFTIARDNAKNMVFLQMNNLKPE<br>DTAVYYCAAGTGCSTYGCFDAQIIDYWGKGTLVTVSSGGGGSGGG<br>GSGGGGSGGGGSGGGGSQVKLEESGGGLVQAGGSLRLSCAASGGTL<br>SKNTVAWVRQAPGKERGFVTSITCDGRTTYYANSVNGRFPINRNNA<br>ENLVVLQMNSLKPDDTALYYCAAYRKSIMSIQPDYWGQGTQVTVSS |
| 3761 | QVKLEESGGRLVQPRGSLRLSCAGSGRTFSTYGMAWFRQAPGKERE<br>FVASKASMNYSGRTYYADSVKGRFTIARDNAKNMVFLQMNNLKPE<br>DTAVYYCAAGTGCSTYGCFDAQIIDYWGKGTLVTVSSGGGGSGGG<br>GSQVKLEESGGGLVQAGGSLRLSCAASGGTLSKNTVAWVRQAPGK<br>ERGFVTSITCDGRTTYYANSVNGRFPINRNNAENLVVLQMNSLKPDD<br>TALYYCAAYRKSIMSIQPDYWGQGTQVTVSS |
| 3762 | QVKLEESGGRLVQPRGSLRLSCAGSGRTFSTYGMAWFRQAPGKERE<br>FVASKASMNYSGRTYYADSVKGRFTIARDNAKNMVFLQMNNLKPE<br>DTAVYYCAAGTGCSTYGCFDAQIIDYWGKGTLVTVSSGGGGSGGG<br>GSGGGGSQVKLEESGGGLVQAGGSLRLSCAASGGTLSKNTVAWVR<br>QAPGKERGFVTSITCDGRTTYYANSVNGRFPINRNNAENLVVLQMN<br>SLKPDDTALYYCAAYRKSIMSIQPDYWGQGTQVTVSS |
| 3763 | QVKLEESGGRLVQPRGSLRLSCAGSGRTFSTYGMAWFRQAPGKERE<br>FVASKASMNYSGRTYYADSVKGRFTIARDNAKNMVFLQMNNLKPE<br>DTAVYYCAAGTGCSTYGCFDAQIIDYWGKGTLVTVSSGGGGSGGG |

TABLE 3-continued

Exemplary BCMA sequences

| SEQ ID NO: | Amino acid sequence |
|---|---|
| | GSGGGGGGGSQVKLEESGGGLVQAGGSLRLSCAASGGTLSKNTV<br>AWVRQAPGKERGFVTSITCDGRTTYYANSVNGRFPINRNNAENLVV<br>LQMNSLKPDDTALYYCAAYRKSIMSIQPDYWGQGTQVTVSS |
| 3764 | QVKLEESGGGLVQAGGSLRLSCAASGGTLSKNTVAWVRQAPGKER<br>GFVTSITCDGRTTYYANSVNGRFPINRNNAENLVVLQMNSLKPDDTA<br>LYYCAAYRKSIMSIQPDYWGQGTQVTVSSGGGGSQVQLVESGGGLV<br>QAGGSLRLSCAASGGTLSKNTVAWFRQAPGKERGFVASITWDGRTT<br>YYADSVKGRFTISRDNAKNTVYLQMNSLKPEDTAVYVCADLGKWP<br>AGPADYWGQGTQVTVSS |
| 3765 | QVKLEESGGGLVQAGGSLRLSCAASGGTLSKNTVAWVRQAPGKER<br>GFVTSITCDGRTTYYANSVNGRFPINRNNAENLVVLQMNSLKPDDTA<br>LYYCAAYRKSIMSIQPDYWGQGTQVTVSSGGGGSGGGGSGGGGSQ<br>VQLVESGGGLVQAGGSLRLSCAASGGTLSKNTVAWFRQAPGKERGF<br>VASITWDGRTTYYADSVKGRFTISRDNAKNTVYLQMNSLKPEDTAV<br>YVCADLGKWPAGPADYWGQGTQVTVSS |
| 3766 | QVKLEESGGGLVQAGGSLRLSCAASGGTLSKNTVAWVRQAPGKER<br>GFVTSITCDGRTTYYANSVNGRFPINRNNAENLVVLQMNSLKPDDTA<br>LYYCAAYRKSIMSIQPDYWGQGTQVTVSSGGGGSGGGGSGGGGS<br>GGGSGGGGSQVQLVESGGGLVQAGGSLRLSCAASGGTLSKNTVAW<br>FRQAPGKERGFVASITWDGRTTYYADSVKGRFTISRDNAKNTVYLQ<br>MNSLKPEDTAVYVCADLGKWPAGPADYWGQGTQVTVSS |
| 3767 | QVKLEESGGGLVQAGGSLRLSCAASGGTLSKNTVAWVRQAPGKER<br>GFVTSITCDGRTTYYANSVNGRFPINRNNAENLVVLQMNSLKPDDTA<br>LYYCAAYRKSIMSIQPDYWGQGTQVTVSSGGGGSGGGGSQVQLVES<br>GGGLVQAGGSLRLSCAASGGTLSKNTVAWFRQAPGKERGFVASITW<br>DGRTTYYADSVKGRFTISRDNAKNTVYLQMNSLKPEDTAVYVCADL<br>GKWPAGPADYWGQGTQVTVSS |
| 3768 | QVKLEESGGGLVQAGGSLRLSCAASGGTLSKNTVAWVRQAPGKER<br>GFVTSITCDGRTTYYANSVNGRFPINRNNAENLVVLQMNSLKPDDTA<br>LYYCAAYRKSIMSIQPDYWGQGTQVTVSSGGGGSGGGGSGGGGSQ<br>VQLVESGGGLVQAGGSLRLSCAASGGTLSKNTVAWFRQAPGKERGF<br>VASITWDGRTTYYADSVKGRFTISRDNAKNTVYLQMNSLKPEDTAV<br>YVCADLGKWPAGPADYWGQGTQVTVSS |
| 3769 | QVKLEESGGGLVQAGGSLRLSCAASGGTLSKNTVAWVRQAPGKER<br>GFVTSITCDGRTTYYANSVNGRFPINRNNAENLVVLQMNSLKPDDTA<br>LYYCAAYRKSIMSIQPDYWGQGTQVTVSSGGGGSGGGGSGGGGSG<br>GGGSQVQLVESGGGLVQAGGSLRLSCAASGGTLSKNTVAWFRQAP<br>GKERGFVASITWDGRTTYYADSVKGRFTISRDNAKNTVYLQMNSLK<br>PEDTAVYVCADLGKWPAGPADYWGQGTQVTVSS |
| 3770 | QVQLVESGGGLVQAGGSLRLSCAASGGTLSKNTVAWFRQAPGKER<br>GFVASITWDGRTTYYADSVKGRFTISRDNAKNTVYLQMNSLKPEDT<br>AVYVCADLGKWPAGPADYWGQGTQVTVSSGGGGSDVQLVESGGG<br>LVQAGGSLRLSCAASGGTLSKNTVAWVRQAPGKERGFVTSITCDGR<br>TTYYANSVKGRFPISRDNAENTVYLQMNSLKPEDTAGYVCADLGK<br>WPAGSADYWGQGTHVTVSS |
| 3771 | QVQLVESGGGLVQAGGSLRLSCAASGGTLSKNTVAWFRQAPGKER<br>GFVASITWDGRTTYYADSVKGRFTISRDNAKNTVYLQMNSLKPEDT<br>AVYVCADLGKWPAGPADYWGQGTQVTVSSGGGGSGGGGSGGGGS<br>DVQLVESGGGLVQAGGSLRLSCAASGGTLSKNTVAWVRQAPGKER<br>GFVTSITCDGRTTYYANSVKGRFPISRDNAENTVYLQMNSLKPEDTA<br>GYVCADLGKWPAGSADYWGQGTHVTVSS |
| 3772 | QVQLVESGGGLVQAGGSLRLSCAASGGTLSKNTVAWFRQAPGKER<br>GFVASITWDGRTTYYADSVKGRFTISRDNAKNTVYLQMNSLKPEDT<br>AVYVCADLGKWPAGPADYWGQGTQVTVSSGGGGSGGGGSGGGGS<br>GGGGSGGGGSDVQLVESGGGLVQAGGSLRLSCAASGGTLSKNTVA<br>WVRQAPGKERGFVTSITCDGRTTYYANSVKGRFPISRDNAENTVYL<br>QMNSLKPEDTAGYVCADLGKWPAGSADYWGQGTHVTVSS |
| 3773 | QVQLVESGGGLVQAGGSLRLSCAASGGTLSKNTVAWFRQAPGKER<br>GFVASITWDGRTTYYADSVKGRFTISRDNAKNTVYLQMNSLKPEDT<br>AVYVCADLGKWPAGPADYWGQGTQVTVSSGGGGSGGGGSDVQLV<br>ESGGGLVQAGGSLRLSCAASGGTLSKNTVAWVRQAPGKERGFVTSI<br>TCDGRTTYYANSVKGRFPISRDNAENTVYLQMNSLKPEDTAGYVCA<br>DLGKWPAGSADYWGQGTHVTVSS |
| 3774 | QVQLVESGGGLVQAGGSLRLSCAASGGTLSKNTVAWFRQAPGKER<br>GFVASITWDGRTTYYADSVKGRFTISRDNAKNTVYLQMNSLKPEDT |

TABLE 3-continued

Exemplary BCMA sequences

| SEQ ID NO: | Amino acid sequence |
|---|---|
| | AVYVCADLGKWPAGPADYWGQGTQVTVSSGGGGSGGGGSGGGGS<br>DVQLVESGGGLVQAGGSLRLSCAASGGTLSKNTVAWVRQAPGKER<br>GFVTSITCDGRTTYYANSVKGRFPISRDNAENTVYLQMNSLKPEDTA<br>GYVCADLGKWPAGSADYWGQGTHVTVSS |
| 3775 | QVQLVESGGGLVQAGGSLRLSCAASGGTLSKNTVAWFRQAPGKER<br>GFVASITWDGRTTYYADSVKGRFTISRDNAKNTVYLQMNSLKPEDT<br>AVYVCADLGKWPAGPADYWGQGTQVTVSSGGGGSGGGGSGGGGS<br>GGGGSDVQLVESGGGLVQAGGSLRLSCAASGGTLSKNTVAWVRQA<br>PGKERGFVTSITCDGRTTYYANSVKGRFPISRDNAENTVYLQMNSLK<br>PEDTAGYVCADLGKWPAGSADYWGQGTHVTVSS | ii. Hinge/Spacer Domain

In some embodiments, a CAR of the instant disclosure comprises a hinge or spacer domain. In some embodiments, the hinge/spacer domain may comprise a truncated hinge/spacer domain (THD) the THD domain is a truncated version of a complete hinge/spacer domain ("CHD"). In some embodiments, an extracellular domain is from or derived from (e.g., comprises all or a fragment of) ErbB2, glycophorin A (GpA), CD2, CD3 delta, CD3 epsilon, CD3 gamma, CD4, CD7, CD8a, CD8[T CD11a (IT GAL), CD11b (IT GAM), CD11c (ITGAX), CD11d (IT GAD), CD18 (ITGB2), CD19 (B34), CD27 (TNFRSF7), CD28, CD28T, CD29 (ITGB1), CD30 (TNFRSF8), CD40 (TNFRSF5), CD48 (SLAMF2), CD49a (ITGA1), CD49d (ITGA4), CD49f (ITGA6), CD66a (CEACAM1), CD66b (CEACAM8), CD66c (CEACAM6), CD66d (CEACAM3), CD66e (CEACAM5), CD69 (CLEC2), CD79A (B-cell antigen receptor complex-associated alpha chain), CD79B (B-cell antigen receptor complex-associated beta chain), CD84 (SLAMIF5), CD96 (Tactile), CD 100 (SEMA4D), CD 103 (ITGAE), CD 134 (OX40), CD 137 (4-1BB), CD150 (SLAMF1), CD158A (KIR2DL1), CD158B1 (KIR2DL2), CD158B2 (KIR2DL3), CD158C (KIR3DP1), CD158D (KIRDL4), CD158F1 (KIR2DL5A), CD158F2 (KIR2DL5B), CD158K (KIR3DL2), CD160 (BY55), CD162 (SELPLG), CD226 (DNAM1), CD229 (SLAMF3), CD244 (SLAMF4), CD247 (CD3-zeta), CD258 (LIGHT), CD268 (BAFFR), CD270 (TNFSF14), CD272 (BTLA), CD276 (B7-H3), CD279 (PD-1), CD314 (NKG2D), CD319 (SLAMF7), CD335 (NK-p46), CD336 (NK-p44), CD337 (NK-p30), CD352 (SLAMF6), CD353 (SLAMF8), CD355 (CRT AM), CD357 (TNFRSF18), inducible T cell co-stimulator (ICOS), LFA-1 (CD11a/CD18), NKG2C, DAP-10, ICAM-1, NKp80 (KLRF1), IL-2R beta, IL-2R gamma, IL-7R alpha, LFA-1, SLAMF9, LAT, GADS (GrpL), SLP-76 (LCP2), PAG1/CBP, a CD83 ligand, Fc gamma receptor, MHC class 1 molecule, MHC class 2 molecule, a TNF receptor protein, an immunoglobulin protein, a cytokine receptor, an integrin, activating NK cell receptors, a Toll ligand receptor, and fragments or combinations thereof. A hinge or spacer domain may be derived either from a natural or from a synthetic source.

In some embodiments, a hinge or spacer domain is positioned between an antigen binding molecule (e.g., an scFv) and a transmembrane domain. In this orientation, the hinge/spacer domain provides distance between the antigen binding molecule and the surface of a cell membrane on which the CAR is expressed. In some embodiments, a hinge or spacer domain is from or derived from an immunoglobulin. In some embodiments, a hinge or spacer domain is selected from the hinge/spacer regions of IgG1, IgG2, IgG3, IgG4, IgA, IgD, IgE, IgM, or a fragment thereof. In some embodiments, a hinge or spacer domain comprises, is from, or is derived from the hinge/spacer region of CD8 alpha. In some embodiments, a hinge or spacer domain comprises, is from, or is derived from the hinge/spacer region of CD28. In some embodiments, a hinge or spacer domain comprises a fragment of the hinge/spacer region of CD8 alpha or a fragment of the hinge/spacer region of CD28, wherein the fragment is anything less than the whole hinge/spacer region. In some embodiments, the fragment of the CD8 alpha hinge/spacer region or the fragment of the CD28 hinge/spacer region comprises an amino acid sequence that excludes at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, or at least 20 amino acids at the N-terminus or C-Terminus, or both, of the CD8 alpha hinge/spacer region, or of the CD28 hinge/spacer region.

iii. Transmembrane Domain

The CAR of the present disclosure may further comprise a transmembrane domain and/or an intracellular signaling domain. The transmembrane domain may be designed to be fused to the extracellular domain of the CAR. It may similarly be fused to the intracellular domain of the CAR. In some embodiments, the transmembrane domain that naturally is associated with one of the domains in a CAR is used. In some instances, the transmembrane domain may be selected or modified (e.g., by an amino acid substitution) to avoid binding of such domains to the transmembrane domains of the same or different surface membrane proteins to minimize interactions with other members of the receptor complex. The transmembrane domain may be derived either from a natural or from a synthetic source. Where the source is natural, the domain may be derived from any membrane-bound or transmembrane protein.

Transmembrane regions may be derived from (i.e. comprise) a receptor tyrosine kinase (e.g., ErbB2), glycophorin A (GpA), 4-1BB/CD137, activating NK cell receptors, an immunoglobulin protein, B7-H3, BAFFR, BFAME (SEAMF8), BTEA, CD100 (SEMA4D), CD103, CD160 (BY55), CD18, CD19, CD19a, CD2, CD247, CD27, CD276 (B7-H3), CD28, CD29, CD3 delta, CD3 epsilon, CD3 gamma, CD30, CD4, CD40, CD49a, CD49D, CD49f, CD69, CD7, CD84, CD8alpha, CD8beta, CD96 (Tactile), CD11a, CD11b, CD11c, CD11d, CDS, CEACAM1, CRT AM, cytokine receptor, DAP-10, DNAM1 (CD226), Fc gamma receptor, GADS, GITR, HVEM (EIGHTR), IA4, ICAM-1, ICAM-1, Ig alpha (CD79a), IE-2R beta, IE-2R gamma, IE-7R alpha, inducible T cell costimulator (ICOS), integrins, ITGA4, ITGA4, ITGA6, IT GAD, ITGAE, ITGAE, IT GAM, ITGAX, ITGB2, ITGB7, ITGB1, KIRDS2, EAT, LFA-1, LFA-1, a ligand that specifically binds with CD83, LIGHT, LIGHT, LTBR, Ly9 (CD229), lymphocyte function-associated antigen-1 (LFA-1; CD1-1a/ CD18), MHC class 1 molecule, NKG2C, NKG2D, NKp30, NKp44, NKp46, NKp80 (KLRF1), OX-40, PAG/Cbp, programmed death-1 (PD-1), PSGL1, SELPLG (CD162), Signaling Lymphocytic Activation Molecules (SLAM proteins), SLAM (SLAMF1; CD150; IPO-3), SLAMF4 (CD244; 2B4), SLAMF6 (NTB-A; Lyl08), SLAMF7, SLP-76, TNF receptor proteins, TNFR2, TNFSFi4, a Toll ligand receptor, TRANCE/RANKL, VLA1, or VLA-6, or a fragment, truncation, or a combination thereof.

In some embodiments, suitable intracellular signaling domain include, but are not limited to, activating Macrophage/Myeloid cell receptors CSFR1, MYD88, CD14, TIE2, TLR4, CR3, CD64, TREM2, DAP10, DAP12, CD169, DECTIN1, CD206, CD47, CD163, CD36, MARCO, TIM4, MERTK, F4/80, CD91, CiQR, LOX-1, CD68, SRA, BAI-1, ABCA7, CD36, CD31, Lactoferrin, or a fragment, truncation, or combination thereof.

In some embodiments, a receptor tyrosine kinase may be derived from (e.g., comprise) Insulin receptor (InsR), Insulin-like growth factor I receptor (IGF1R), Insulin receptor-related receptor (IRR), platelet derived growth factor receptor alpha (PDGFRa), platelet derived growth factor receptor beta (PDGFRfi). KIT proto-oncogene receptor tyrosine kinase (Kit), colony stimulating factor 1 receptor (CSFR), fms related tyrosine kinase 3 (FLT3), fms related tyrosine kinase 1 (VEGFR-1), kinase insert domain receptor (VEGFR-2), fms related tyrosine kinase 4 (VEGFR-3), fibroblast growth factor receptor 1 (FGFR1), fibroblast growth factor receptor 2 (FGFR2), fibroblast growth factor receptor 3 (FGFR3), fibroblast growth factor receptor 4 (FGFR4), protein tyrosine kinase 7 (CCK4), neurotrophic receptor tyrosine kinase 1 (trkA), neurotrophic receptor tyrosine kinase 2 (trkB), neurotrophic receptor tyrosine kinase 3 (trkC), receptor tyrosine kinase like orphan receptor 1 (ROR1), receptor tyrosine kinase like orphan receptor 2 (ROR2), muscle associated receptor tyrosine kinase (MuSK), MET proto-oncogene, receptor tyrosine kinase (MET), macrophage stimulating 1 receptor (Ron), AXL receptor tyrosine kinase (Axl), TYR03 protein tyrosine kinase (Tyro3), MER proto-oncogene, tyrosine kinase (Mer), tyrosine kinase with immunoglobulin like and EGF like domains 1 (TIE1), TEK receptor tyrosine kinase (TIE2), EPH receptor A1 (EphA1), EPH receptor A2 (EphA2), (EPH receptor A3) EphA3, EPH receptor A4 (EphA4), EPH receptor A5 (EphA5), EPH receptor A6 (EphA6), EPH receptor A7 (EphA7), EPH receptor A8 (EphA8), EPH receptor A10 (EphAlO), EPH receptor B1 (EphB1), EPH receptor B2 (EphB2), EPH receptor B3 (EphB3), EPH receptor B4 (EphB4), EPH receptor B6 (EphB6), ret proto oncogene (Ret), receptor-like tyrosine kinase (RYK), discoidin domain receptor tyrosine kinase 1 (DDR1), discoidin domain receptor tyrosine kinase 2 (DDR2), c-ros oncogene 1, receptor tyrosine kinase (ROS), apoptosis associated tyrosine kinase (Lmr1), lemur tyrosine kinase 2 (Lmr2), lemur tyrosine kinase 3 (Lmr3), leukocyte receptor tyrosine kinase (LTK), ALK receptor tyrosine kinase (ALK), or serine/threonine/tyrosine kinase 1 (STYK1).

iv. Costimulatory Domain

In certain embodiments, the CAR comprises a costimulatory domain. In some embodiments, the costimulatory domain comprises 4-1BB (CD137), CD28, or both, and/or an intracellular T cell signaling domain. In a preferred embodiment, the costimulatory domain is human CD28, human 4-1BB, or both, and the intracellular T cell signaling domain is human CD3 zeta (ζ). 4-1BB, CD28, CD3 zeta may comprise less than the whole 4-1BB, CD28 or CD3 zeta, respectively. Chimeric antigen receptors may incorporate costimulatory (signaling) domains to increase their potency. See U.S. Pat. Nos. 7,741,465, and 6,319,494, as well as Krause et al. and Finney et al. (supra), Song et al., Blood 119:696-706 (2012); Kalos et al., Sci Transl. Med. 3:95 (2011); Porter et al., N. Engl. J. Med. 365:725-33 (2011), and Gross et al., Amur. Rev. Pharmacol. Toxicol. 56:59-83 (2016).

In some embodiments, a costimulatory domain comprises the amino acid sequence of SEQ ID NO: 3544 or 3546.

v. Intracellular Signalling Domain

The intracellular (signaling) domain of the engineered T cells disclosed herein may provide signaling to an activating domain, which then activates at least one of the normal effector functions of the immune cell. Effector function of a T cell, for example, may be cytolytic activity or helper activity including the secretion of cytokines.

In some embodiments, suitable intracellular signaling domain include (e.g., comprise), but are not limited to 4-1BB/CD137, activating NK cell receptors, an Immunoglobulin protein, B7-H3, BAFFR, BLAME (SLAMF8), BTLA, CD100 (SEMA4D), CD103, CD160 (BY55), CD18, CD19, CD 19a, CD2, CD247, CD27, CD276 (B7-H3), CD28, CD29, CD3 delta, CD3 epsilon, CD3 gamma, CD30, CD4, CD40, CD49a, CD49D, CD49f, CD69, CD7, CD84, CD8alpha, CD8beta, CD96 (Tactile), CD11a, CD11b, CD11c, CD11d, CDS, CEACAM1, CRT AM, cytokine receptor, DAP-10, DNAM1 (CD226), Fc gamma receptor, GADS, GITR, HVEM (LIGHTR), IA4, ICAM-1, Ig alpha (CD79a), IL-2R beta, IL-2R gamma, IL-7R alpha, inducible T cell costimulator (ICOS), integrins, ITGA4, ITGA6, ITGAD, ITGAE, ITGAL, ITGAM, ITGAX, ITGB2, ITGB7, ITGB1, KIRDS2, LAT, LFA-1, ligand that specifically binds with CD83, LIGHT, LTBR, Ly9 (CD229), Lyl08, lymphocyte function-associated antigen-1 (LFA-1; CD1-1a/ CD18), MHC class 1 molecule, NKG2C, NKG2D, NKp30, NKp44, NKp46, NKp80 (KLRF1), OX-40, PAG/Cbp, programmed death-1 (PD-1), PSGL1, SELPLG (CD162), Signaling Lymphocytic Activation Molecules (SLAM proteins), SLAM (SLAMF1; CD150; IPO-3), SLAMF4 (CD244; 2B4), SLAMF6 (NTB-A), SLAMF7, SLP-76, TNF receptor proteins, TNFR2, TNFSF14, a Toll ligand receptor, TRANCE/RANKL, VLA1, or VLA-6, or a fragment, truncation, or a combination thereof.

CD3 is an element of the T cell receptor on native T cells, and has been shown to be an important intracellular activating element in CARs. In some embodiments, the CD3 is CD3 zeta. In some embodiments, the activating domain comprises an amino acid sequence at least about 60%, at least about 65%, at least about 70%, at least about 75%, at least about 80%, at least about 85%, at least about 90%, at least about 95%, at least about 96%, at least about 97%, at least about 98%, at least about 99%, or about 100% identical to the polypeptide sequence of SEQ ID NO: 3545.

b. T-Cell Receptors (TCR)

TCRs are described using the International Immunogenetics (IMGT) TCR nomenclature, and links to the IMGT public database of TCR sequences. Native alpha-beta heterodimeric TCRs have an alpha chain and a beta chain. Broadly, each chain may comprise variable, joining and constant regions, and the beta chain also usually contains a short diversity region between the variable and joining regions, but this diversity region is often considered as part of the joining region. Each variable region may comprise three CDRs (Complementarity Determining Regions) embedded in a framework sequence, one being the hypervariable region named CDR3. There are several types of alpha chain variable (Vα) regions and several types of beta chain variable (Vβ) regions distinguished by their framework, CDR1 and CDR2 sequences, and by a partly defined CDR3 sequence. The Vα types are referred to in IMGT nomenclature by a unique TRAV number. Thus "TRAV21" defines a TCR Vα region having unique framework and CDR1 and CDR2 sequences, and a CDR3 sequence which is partly defined by an amino acid sequence which is preserved from TCR to TCR but which also includes an amino acid sequence which varies from TCR to TCR. In the same way, "TRBV5-1" defines a TCR Vβ region having unique framework and CDR1 and CDR2 sequences, but with only a partly defined CDR3 sequence.

The joining regions of the TCR are similarly defined by the unique IMGT TRAJ and TRBJ nomenclature, and the constant regions by the IMGT TRAC and TRBC nomenclature.

The beta chain diversity region is referred to in IMGT nomenclature by the abbreviation TRBD, and, as mentioned, the concatenated TRBD/TRBJ regions are often considered together as the joining region.

The unique sequences defined by the IMGT nomenclature are widely known and accessible to those working in the TCR field. For example, they can be found in the IMGT public database. The "T cell Receptor Factsbook", (2001) LeFranc and LeFranc, Academic Press, ISBN 0-12-441352-8 also discloses sequences defined by the IMGT nomenclature, but because of its publication date and consequent time-lag, the information therein sometimes needs to be confirmed by reference to the IMGT database.

Native TCRs exist in heterodimeric αβ or γδ forms. However, recombinant TCRs consisting of αα or ββ homodimers have previously been shown to bind to peptide MHC molecules. Therefore, the TCR of the invention may be a heterodimeric αβ TCR or may be an αα or ββ homodimeric TCR.

For use in adoptive therapy, an αβ heterodimeric TCR may, for example, be transfected as full length chains having both cytoplasmic and transmembrane domains. In certain embodiments TCRs of the invention may have an introduced disulfide bond between residues of the respective constant domains, as described, for example, in WO 2006/000830.

TCRs of the invention, particularly alpha-beta heterodimeric TCRs, may comprise an alpha chain TRAC constant domain sequence and/or a beta chain TRBC1 or TRBC2 constant domain sequence. The alpha and beta chain constant domain sequences may be modified by truncation or substitution to delete the native disulfide bond between Cys4 of exon 2 of TRAC and Cys2 of exon 2 of TRBC1 or TRBC2. The alpha and/or beta chain constant domain sequence(s) may also be modified by substitution of cysteine residues for Thr 48 of TRAC and Ser 57 of TRBC1 or TRBC2, the said cysteines forming a disulfide bond between the alpha and beta constant domains of the TCR.

Binding affinity (inversely proportional to the equilibrium constant $K_D$) and binding half-life (expressed as T½) can be determined by any appropriate method. It will be appreciated that doubling the affinity of a TCR results in halving the $K_D$. T½ is calculated as ln 2 divided by the off-rate (koff). So doubling of T½ results in a halving in koff $K_D$ and koff values for TCRs are usually measured for soluble forms of the TCR, i.e. those forms which are truncated to remove cytoplasmic and transmembrane domain residues. Therefore it is to be understood that a given TCR has an improved binding affinity for, and/or a binding half-life for the parental TCR if a soluble form of that TCR has the said characteristics. Preferably the binding affinity or binding half-life of a given TCR is measured several times, for example 3 or more times, using the same assay protocol, and an average of the results is taken.

Since the TCRs of the invention have utility in adoptive therapy, the invention includes a non-naturally occurring and/or purified and/or or engineered cell, especially a T-cell, presenting a TCR of the invention. There are a number of methods suitable for the transfection of T cells with nucleic acid (such as DNA, cDNA or RNA) encoding the TCRs of the invention (see for example Robbins et al., (2008) J Immunol. 180: 6116-6131). T cells expressing the TCRs of the invention will be suitable for use in adoptive therapy-based treatment of cancers such as those of the pancreas and liver. As will be known to those skilled in the art, there are a number of suitable methods by which adoptive therapy can be carried out (see for example Rosenberg et al., (2008) Nat Rev Cancer 8(4): 299-308).

As is well-known in the art TCRs of the invention may be subject to post-translational modifications when expressed by transfected cells. Glycosylation is one such modification, which may comprise the covalent attachment of oligosaccharide moieties to defined amino acids in the TCR chain. For example, asparagine residues, or serine/threonine residues are well-known locations for oligosaccharide attachment. The glycosylation status of a particular protein depends on a number of factors, including protein sequence, protein conformation and the availability of certain enzymes. Furthermore, glycosylation status (i.e oligosaccharide type, covalent linkage and total number of attachments) can influence protein function. Therefore, when producing recombinant proteins, controlling glycosylation is often desirable. Glycosylation of transfected TCRs may be controlled by mutations of the transfected gene (Kuball J et al. (2009), J Exp Med 206(2):463-475). Such mutations are also encompassed in this invention.

A TCR may be specific for an antigen in the group MAGE-A1, MAGE-A2, MAGE-A3, MAGE-A4, MAGE-A5, MAGE-A6, MAGE-A7, MAGE-A8, MAGE-A9, MAGE-A10, MAGE-A11, MAGE-A12, MAGE-A13, GAGE-1, GAGE-2, GAGE-3, GAGE-4, GAGE-5, GAGE-6, GAGE-7, GAGE-8, BAGE-1, RAGE-1, LB33/MUM-1, PRAME, NAG, MAGE-Xp2 (MAGE-B2), MAGE-Xp3 (MAGE-B3), MAGE-Xp4 (AGE-B4), tyrosinase, brain glycogen phosphorylase, Melan-A, MAGE-C1, MAGE-C2, NY-ESO-1, LAGE-1, SSX-1, SSX-2 (HOM-MEL-40), SSX-1, SSX-4, SSX-5, SCP-1, CT-7, alpha-actinin-4, Bcr-Abl fusion protein, Casp-8, beta-catenin, cdc27, cdk4, cdkn2a, coa-1, dek-can fusion protein, EF2, ETV6-AML1 fusion protein, LDLR-fucosyltransferaseAS fusion protein, HLA-A2, HLA-A11, hsp70-2, KIAAO205, Mart2, Mum-2, and 3, neo-PAP, myosin class I, OS-9, pml-RARa fusion protein, PTPRK, K-ras, N-ras, Triosephosphate isomeras, GnTV, Herv-K-mel, Lage-1, Mage-C2, NA-88, Lage-2, SP17, and TRP2-Int2, (MART-I), gp100 (Pmel 17), TRP-1, TRP-2, MAGE-1, MAGE-3, p15(58), CEA, NY-ESO (LAGE), SCP-1, Hom/Mel-40, p53, H-Ras, HER-2/neu, BCR-ABL, E2A-PRL, H4-RET, IGH-IGK, MYL-RAR, Epstein Barr virus antigens, EBNA, human papillomavirus (HPV) antigens E6 and E7, TSP-180, MAGE-4, MAGE-5, MAGE-6, p185erbB2, p180erbB-3, c-met, nm-23H1, PSA, TAG-72-4, CA 19-9, CA 72-4, CAM 17.1, NuMa, K-ras, beta-catenin, CDK4, Mum-1, p16, TAGE, PSMA, PSCA, CT7, telomerase, 43-9F, 5T4, 791Tgp72, α-fetoprotein, 13HCG, BCA225, BTAA, CA 125, CA 15-3 (CA 27.29\BCAA), CA 195, CA 242, CA-50, CAM43, CD68\KP1, CO-029, FGF-5, G250, Ga733 (EpCAM), HTgp-175, M344, MA-50, MG7-Ag, MOV18, NB\170K, NY-CO-1, RCAS1, SDCCAG16, TA-90 (Mac-2 binding protein\cyclophilin C-associated protein), TAAL6, TAG72, TLP, and TPS.

c. B-Cell Receptors (BCR)

B-cell receptors (BCRs) or B-cell antigen receptors are immunoglobulin molecules that form a type I transmembrane protein on the surface of a B cell. A BCR is capable of transmitting activatory signal into a B cell following recognition of a specific antigen. Prior to binding of a B cell to an antigen, the BCR will remain in an unstimulated or "resting" stage. Binding of an antigen to a BCR leads to signaling that initiates a humoral immune response.

A BCR is expressed by mature B cells. These B cells work with immunoglobulins (Igs) in recognizing and tagging pathogens. The typical BCR comprises a membrane-bound immunoglobulin (e.g., mIgA, mIgD, mIgE, mIgG, and mIgM), along with associated and Igα/Igβ (CD79a/CD79b) heterodimers (α/β). These membrane-bound immunoglobulins are tetramers consisting of two identical heavy and two light chains. Within the BCR, the membrane bound immunoglobulins is capable of responding to antigen binding by signal transmission across the plasma membrane leading to B cell activation and consequently clonal expansion and specific antibody production (Friess M et al. (2018), Front. Immunol. 2947(9)). The Igα/Igβ heterodimers is responsible for transducing signals to the cell interior.

A Igα/Igβ heterodimer signaling relies on the presence of immunoreceptor tyrosine-based activation motifs (ITAMs) located on each of the cytosolic tails of the heterodimers. ITAMs comprise two tyrosine residues separated by 9-12 amino acids (e.g., tyrosine, leucine, and/or valine). Upon binding of an antigen, the tyrosine of the BCR's ITAMs become phosphorylated by Src-family tyrosine kinases Blk, Fyn, or Lyn (Janeway C et al., Immunobiology: The Immune System in Health and Disease (Garland Science, 5th ed. 2001)).

d. Other Chimeric Proteins

In addition to the chimeric proteins provided above, the circular RNA polynucleotide may encode for a various number of other chimeric proteins available in the art. The chimeric proteins may include recombinant fusion proteins, chimeric mutant protein, or other fusion proteins.

B. Immune Modulatory Ligands

In some embodiments, the circular RNA polynucleotide encodes for an immune modulatory ligand. In certain embodiments, the immune modulatory ligand may be immunostimulatory; while in other embodiments, the immune modulatory ligand may be immunosuppressive.

a. Cytokines: Interferon, Chemokines, Interleukins, Growth Factor & Others

In some embodiments, the circular RNA polynucleotide encodes for a cytokine. In some embodiments, the cytokine comprises a chemokine, interferon, interleukin, lymphokine, and tumor necrosis factor. Chemokines are chemotactic cytokine produced by a variety of cell types in acute and chronic inflammation that mobilizes and activates white blood cells. An interferon comprises a family of secreted α-helical cytokines induced in response to specific extracellular molecules through stimulation of TLRs (Borden, Molecular Basis of Cancer (Fourth Edition) 2015). Interleukins are cytokines expressed by leukocytes.

Descriptions and/or amino acid sequences of IL-2, IL-7, IL-10, IL-12, IL-15, IL-18, IL-270, IFNγ, and/or TGFβ1 are provided herein and at the www.uniprot.org database at accession numbers: P60568 (IL-2), P29459 (IL-12A), P29460 (IL-12B), P13232 (IL-7), P22301 (IL-10), P40933 (IL-15), Q14116 (IL-18), Q14213 (IL-270), P01579 (IFNγ), and/or P01137 (TGFβ1).

C. Transcription Factors

Regulatory T cells (Treg) are important in maintaining homeostasis, controlling the magnitude and duration of the inflammatory response, and in preventing autoimmune and allergic responses.

In general, Tregs are thought to be mainly involved in suppressing immune responses, functioning in part as a "self-check" for the immune system to prevent excessive reactions. In particular, Tregs are involved in maintaining tolerance to self-antigens, harmless agents such as pollen or food, and abrogating autoimmune disease.

Tregs are found throughout the body including, without limitation, the gut, skin, lung, and liver. Additionally, Treg cells may also be found in certain compartments of the body that are not directly exposed to the external environment such as the spleen, lymph nodes, and even adipose tissue. Each of these Treg cell populations is known or suspected to have one or more unique features and additional information may be found in Lehtimaki and Lahesmaa, Regulatory T cells control immune responses through their non-redundant tissue specific features, 2013, FRONTIERS IN IMMUNOL., 4(294): 1-10, the disclosure of which is hereby incorporated in its entirety.

Typically, Tregs are known to require TGF-β and IL-2 for proper activation and development. Tregs, expressing abundant amounts of the IL-2 receptor (IL-2R), are reliant on IL-2 produced by activated T cells. Tregs are known to produce both IL-10 and TGF-β, both potent immune suppressive cytokines. Additionally, Tregs are known to inhibit the ability of antigen presenting cells (APCs) to stimulate T cells. One proposed mechanism for APC inhibition is via CTLA-4, which is expressed by Foxp3+ Tregs. It is thought that CTLA-4 may bind to B7 molecules on APCs and either block these molecules or remove them by causing internalization resulting in reduced availability of B7 and an inability to provide adequate co-stimulation for immune responses. Additional discussion regarding the origin, differentiation and function of Tregs may be found in Dhamne et al., Peripheral and thymic Foxp3+ regulatory T cells in search of origin, distinction, and function, 2013, Frontiers in Immunol., 4 (253): 1-11, the disclosure of which is hereby incorporated in its entirety.

D. Checkpoint Inhibitors & Agonists

As provided herein, in certain embodiments, the coding element of the circular RNA encodes for one or more checkpoint inhibitors or agonists.

In some embodiments, the immune checkpoint inhibitor is an inhibitor of Programmed Death-Ligand 1 (PD-L1, also known as B7-H1, CD274), Programmed Death 1 (PD-1), CTLA-4, PD-L2 (B7-DC, CD273), LAG3, TIM3, 2B4, A2aR, B7H1, B7H3, B7H4, BTLA, CD2, CD27, CD28, CD30, CD40, CD70, CD80, CD86, CD137, CD160, CD226, CD276, DR3, GAL9, GITR, HAVCR2, HVEM, IDO1, IDO2, ICOS (inducible T cell costimulator), KIR, LAIR1, LIGHT, MARCO (macrophage receptor with collageneous structure), PS (phosphatidylserine), OX-40, SLAM, TIGHT, VISTA, VTCN1, or any combinations thereof. In some embodiments, the immune checkpoint inhibitor is an inhibitor of IDO1, CTLA4, PD-1, LAG3, PD-L1, TIM3, or combinations thereof. In some embodiments, the immune checkpoint inhibitor is an inhibitor of PD-L1. In some embodiments, the immune checkpoint inhibitor is an inhibitor of PD-1. In some embodiments, the immune checkpoint inhibitor is an inhibitor of CTLA-4. In some embodiments, the immune checkpoint inhibitor is an inhibitor of LAG3. In some embodiments, the immune checkpoint inhibitor is an inhibitor of TIM3. In some embodiments, the immune checkpoint inhibitor is an inhibitor of IDO1.

As described herein, at least in one aspect, the invention encompasses the use of immune checkpoint antagonists. Such immune checkpoint antagonists include antagonists of immune checkpoint molecules such as Cytotoxic T-Lymphocyte Antigen 4 (CTLA-4), Programmed Cell Death Protein 1 (PD-1), Programmed Death-Ligand 1 (PDL-1), Lymphocyte-activation gene 3 (LAG-3), and T-cell immunoglobulin and mucin domain 3 (TIM-3). An antagonist of CTLA-4, PD-1, PDL-1, LAG-3, or TIM-3 interferes with CTLA-4, PD-1, PDL-1, LAG-3, or TIM-3 function, respectively. Such antagonists of CTLA-4, PD-1, PDL-1, LAG-3, and TIM-3 can include antibodies which specifically bind to CTLA-4, PD-1, PDL-1, LAG-3, and TIM-3, respectively and inhibit and/or block biological activity and function.

E. Others

In some embodiments, the payload encoded within one or more of the coding elements is a hormone, FC fusion protein, anticoagulant, blood clotting factor, protein associated with deficiencies and genetic disease, a chaperone protein, an antimicrobial protein, an enzyme (e.g., metabolic enzyme), a structural protein (e.g., a channel or nuclear pore protein), protein variant, small molecule, antibody, nanobody, an engineered non-body antibody, or a combination thereof.

4. Additional Accessory Elements (Sequence Elements)

As described in this invention, the circular RNA polynucleotide, linear RNA polynucleotide, and/or DNA template may further comprise of accessory elements. In certain embodiments, these accessory elements may be included within the sequences of the circular RNA, linear RNA polynucleotide and/or DNA template for enhancing circularization, translation or both. Accessory elements are sequences, in certain embodiments that are located with specificity between or within the enhanced intron elements, enhanced exon elements, or core functional element of the respective polynucleotide. As an example, but not intended to be limiting, an accessory element includes, a IRES transacting factor region, a miRNA binding site, a restriction site, an RNA editing region, a structural or sequence element, a granule site, a zip code element, an RNA trafficking element or another specialized sequence as found in the art that enhances promotes circularization and/or translation of the protein encoded within the circular RNA polynucleotide.

A. IRES Transacting Factors

In certain embodiments, the accessory element comprises an IRES transacting factor (ITAF) region. In some embodiments, the IRES transacting factor region modulates the initiation of translation through binding to PCBP1-PCBP4 (polyC binding protein), PABP1 (polyA binding protein), PTB (polyprimidine tract binding), Argonaute protein family, HNRNPK (Heterogeneous nuclear ribonucleoprotein K protein), or La protein. In some embodiments, the IRES transacting factor region comprises a polyA, polyC, polyAC, or polyprimidine track.

In some embodiments, the ITAF region is located within the core functional element. In some embodiments, the ITAF region is located within the TIE.

B. miRNA Binding Sites

In certain embodiments, the accessory element comprises a miRNA binding site. In some embodiments the miRNA binding site is located within the 5' enhanced intron element, 5' enhanced exon element, core functional element, 3' enhanced exon element, and/or 3' enhanced intron element.

In some embodiments, wherein the miRNA binding site is located within the spacer within the enhanced intron element or enhanced exon element. In certain embodiments, the miRNA binding site comprises the entire spacer regions.

In some embodiments, the 5' enhanced intron element and 3' enhanced intron elements each comprise identical miRNA binding sites. In another embodiment, the miRNA binding site of the 5' enhanced intron element comprises a different, in length or nucleotides, miRNA binding site than the 3' enhanced intron element. In one embodiment, the 5' enhanced exon element and 3' enhanced exon element comprise identical miRNA binding sites. In other embodiments, the 5' enhanced exon element and 3' enhanced exon element comprises different, in length or nucleotides, miRNA binding sites.

In some embodiments, the miRNA binding sites are located adjacent to each other within the circular RNA polynucleotide, linear RNA polynucleotide precursor, and/or DNA template. In certain embodiments, the first nucleotide of one of the miRNA binding sites follows the first nucleotide last nucleotide of the second miRNA binding site.

In some embodiments, the miRNA binding site is located within a translation initiation element (TIE) of a core functional element. In one embodiment, the miRNA binding site is located before, trailing or within an internal ribosome entry site (IRES). In another embodiment, the miRNA binding site is located before, trailing, or within an aptamer complex.

Incorporation of miRNA sequences within a circular RNA molecule can permit tissue-specific expression of a coding sequence within a core functional element. For example, in a circular RNA intended to express a protein in immune cells, miRNA binding sequences resulting in expression suppression in tissues such as the liver or kidney may be desired. Such miRNA binding sequences may be selected based on the cell or tissue expression of miRNAs.

The unique sequences defined by the miRNA nomenclature are widely known and accessible to those working in the microRNA field. For example, they can be found in the miRDB public database.

5. Production of Polynucleotides

The DNA templates provided herein can be made using standard techniques of molecular biology. For example, the various elements of the vectors provided herein can be obtained using recombinant methods, such as by screening cDNA and genomic libraries from cells, or by deriving the polynucleotides from a DNA template known to include the same.

The various elements of the DNA template provided herein can also be produced synthetically, rather than cloned, based on the known sequences. The complete sequence can be assembled from overlapping oligonucleotides prepared by standard methods and assembled into the complete sequence. See, e.g., Edge, Nature (1981) 292:756; Nambair et al., Science (1984) 223: 1299; and Jay et al., J. Biol. Chem. (1984) 259:631 1.

Thus, particular nucleotide sequences can be obtained from DNA template harboring the desired sequences or synthesized completely, or in part, using various oligonucleotide synthesis techniques known in the art, such as site-directed mutagenesis and polymerase chain reaction (PCR) techniques where appropriate. One method of obtaining nucleotide sequences encoding the desired DNA template elements is by annealing complementary sets of overlapping synthetic oligonucleotides produced in a conventional, automated polynucleotide synthesizer, followed by ligation with an appropriate DNA ligase and amplification of the ligated nucleotide sequence via PCR. See, e.g., Jayaraman et al., Proc. Natl. Acad. Sci. USA (1991) 88:4084-4088. Additionally, oligonucleotide-directed synthesis (Jones et al., Nature (1986) 54:75-82), oligonucleotide directed mutagenesis of preexisting nucleotide regions (Riechmann et al., Nature (1988) 332:323-327 and Verhoeyen et al., Science (1988) 239: 1534-1536), and enzymatic filling-in of gapped oligonucleotides using T4 DNA polymerase (Queen et al., Proc. Natl. Acad. Sci. USA (1989) 86: 10029-10033) can be used.

The precursor RNA provided herein can be generated by incubating a DNA template provided herein under conditions permissive of transcription of the precursor RNA encoded by the DNA template. For example, in some embodiments a precursor RNA is synthesized by incubating a DNA template provided herein that comprises an RNA polymerase promoter upstream of its 5' duplex sequence and/or expression sequences with a compatible RNA polymerase enzyme under conditions permissive of in vitro transcription. In some embodiments, the DNA template is incubated inside of a cell by a bacteriophage RNA polymerase or in the nucleus of a cell by host RNA polymerase II.

In certain embodiments, provided herein is a method of generating precursor RNA by performing in vitro transcription using a DNA template provided herein as a template (e.g., a vector provided herein with an RNA polymerase promoter positioned upstream of the 5' duplex region).

In certain embodiments, the resulting precursor RNA can be used to generate circular RNA (e.g., a circular RNA polynucleotide provided herein) by incubating it in the presence of magnesium ions and guanosine nucleotide or nucleoside at a temperature at which RNA circularization occurs (e.g., between 20° C. and 60° C.).

Thus, in certain embodiments provided herein is a method of making circular RNA. In certain embodiments, the method comprises synthesizing precursor RNA by transcription (e.g., run-off transcription) using a vector provided herein (e.g., a 5' enhanced intron element, a 5' enhanced exon element, a core functional element, a 3' enhanced exon element, and a 3' enhanced intron element) as a template, and incubating the resulting precursor RNA in the presence of divalent cations (e.g., magnesium ions) and GTP such that it circularizes to form circular RNA. In some embodiments, the precursor RNA disclosed herein is capable of circularizing in the absence of magnesium ions and GTP and/or without the step of incubation with magnesium ions and GTP. It has been discovered that circular RNA has reduced immunogenicity relative to a corresponding mRNA, at least partially because the mRNA contains an immunogenic 5' cap. When transcribing a DNA vector from certain promoters (e.g., a T7 promoter) to produce a precursor RNA, it is understood that the 5' end of the precursor RNA is G. To reduce the immunogenicity of a circular RNA composition that contains a low level of contaminant linear mRNA, an excess of GMP relative to GTP can be provided during transcription such that most transcripts contain a 5' GMP, which cannot be capped. Therefore, in some embodiments, transcription is carried out in the presence of an excess of GMP. In some embodiments, transcription is carried out where the ratio of GMP concentration to GTP concentration is within the range of about 3:1 to about 15:1, for example, about 3:1 to about 10:1, about 3:1 to about 5:1, about 3:1, about 4:1, or about 5:1.

In some embodiments, a composition comprising circular RNA has been purified. Circular RNA may be purified by any known method commonly used in the art, such as column chromatography, gel filtration chromatography, and size exclusion chromatography. In some embodiments, purification comprises one or more of the following steps: phosphatase treatment, HPLC size exclusion purification, and RNase R digestion. In some embodiments, purification comprises the following steps in order: RNase R digestion, phosphatase treatment, and HPLC size exclusion purification. In some embodiments, purification comprises reverse phase HPLC. In some embodiments, a purified composition contains less double stranded RNA, DNA splints, triphosphorylated RNA, phosphatase proteins, protein ligases, capping enzymes and/or nicked RNA than unpurified RNA. In some embodiments, purification of circular RNA comprises an affinity-purification or negative selection method described herein. In some embodiments, purification of circular RNA comprises separation of linear RNA from circular RNA using oligonucleotides that are complementary to a sequence in the linear RNA but are not complementary to a sequence in the circular RNA. In some embodiments, a purified composition is less immunogenic than an unpurified composition. In some embodiments, immune cells exposed to a purified composition produce less TNFα, RIG-I, IL-2, IL-6, IFNγ, and/or a type 1 interferon, e.g., IFN-β1, than immune cells exposed to an unpurified composition.

6. Overview of Transfer Vehicle & Other Delivery Mechanisms

A. Ionizable Lipids

In certain embodiments disclosed herein are ionizable lipids that may be used as a component of a transfer vehicle to facilitate or enhance the delivery and release of circular RNA to one or more target cells (e.g., by permeating or fusing with the lipid membranes of such target cells). In certain embodiments, an ionizable lipid comprises one or more cleavable functional groups (e.g., a disulfide) that allow, for example, a hydrophilic functional head-group to dissociate from a lipophilic functional tail-group of the compound (e.g., upon exposure to oxidative, reducing or acidic conditions), thereby facilitating a phase transition in the lipid bilayer of the one or more target cells.

In some embodiments, an ionizable lipid is a lipid as described in international patent application PCT/US2018/058555.

In some of embodiments, a cationic lipid has the following formula:

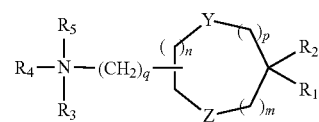

wherein:
  $R_1$ and $R_2$ are either the same or different and independently optionally substituted $C_{10}$-$C_{24}$ alkyl, optionally substituted $C_{10}$-$C_{24}$ alkenyl, optionally substituted $C_{10}$-$C_{24}$ alkynyl, or optionally substituted $C_{10}$-$C_{24}$ acyl;

R$_3$ and R$_4$ are either the same or different and independently optionally substituted C$_1$-C$_6$ alkyl, optionally substituted C$_2$-C$_6$ alkenyl, or optionally substituted C$_2$-C$_6$ alkynyl or R$_3$ and R$_4$ may join to form an optionally substituted heterocyclic ring of 4 to 6 carbon atoms and 1 or 2 heteroatoms chosen from nitrogen and oxygen;

R$_5$ is either absent or present and when present is hydrogen or C$_1$-C$_6$ alkyl; m, n, and p are either the same or different and independently either 0 or 1 with the proviso that m, n, and p are not simultaneously 0; q is 0, 1, 2, 3, or 4; and Y and Z are either the same or different and independently O, S, or NH.

In one embodiment, R$_1$ and R$_2$ are each linoleyl, and the amino lipid is a dilinoleyl amino lipid.

In one embodiment, the amino lipid is a dilinoleyl amino lipid.

In various other embodiments, a cationic lipid has the following structure:

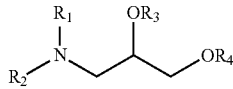

or a pharmaceutically acceptable salt, tautomer, prodrug or stereoisomer thereof, wherein:

R$_1$ and R$_2$ are each independently selected from the group consisting of H and C$_1$-C$_3$ alkyls; and R$_3$ and R$_4$ are each independently an alkyl group having from about 10 to about 20 carbon atoms, wherein at least one of R$_3$ and R$_4$ comprises at least two sites of unsaturation.

In some embodiments, R$_3$ and R$_4$ are each independently selected from dodecadienyl, tetradecadienyl, hexadecadienyl, linoleyl, and icosadienyl. In an embodiment, R$_3$ and R$_4$ and are both linoleyl. In some embodiments, R$_3$ and/or R$_4$ may comprise at least three sites of unsaturation (e.g., R$_3$ and/or R$_4$ may be, for example, dodecatrienyl, tetradectrienyl, hexadecatrienyl, linolenyl, and icosatrienyl).

In some embodiments, a cationic lipid has the following structure:

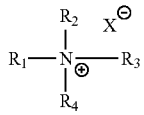

or a pharmaceutically acceptable salt, tautomer, prodrug or stereoisomer thereof, wherein:

R$_1$ and R$_2$ are each independently selected from H and C$_1$-C$_3$ alkyls;

R$_3$ and R$_4$ are each independently an alkyl group having from about 10 to about 20 carbon atoms, wherein at least one of R$_3$ and R$_4$ comprises at least two sites of unsaturation.

In one embodiment, R$_3$ and R$_4$ are the same, for example, in some embodiments R$_3$ and R$_4$ are both linoleyl (C$_{18}$-alkyl). In another embodiment, R$_3$ and R$_4$ are different, for example, in some embodiments, R$_3$ is tetradectrienyl (C$_{14}$-alkyl) and R$_4$ is linoleyl (C$_{18}$-alkyl). In a preferred embodiment, the cationic lipid(s) of the present invention are symmetrical, i.e., R$_3$ and R$_4$ are the same. In another preferred embodiment, both R$_3$ and R$_4$ comprise at least two sites of unsaturation. In some embodiments, R$_3$ and R$_4$ are each independently selected from dodecadienyl, tetradecadienyl, hexadecadienyl, linoleyl, and icosadienyl. In an embodiment, R$_3$ and R$_4$ are both linoleyl. In some embodiments, R$_3$ and/or R$_4$ comprise at least three sites of unsaturation and are each independently selected from dodecatrienyl, tetradectrienyl, hexadecatrienyl, linolenyl, and icosatrienyl.

In various embodiments, a cationic lipid has the formula:

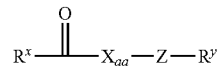

or a pharmaceutically acceptable salt, tautomer, prodrug or stereoisomer thereof, wherein:

X$_{aa}$ is a D- or L-amino acid residue having the formula —NR$^N$—CR$^1$R$^2$—C(C=O)—, or a peptide or a peptide of amino acid residues having the formula —{NR$^N$—CR$^1$R$^2$—C(C=O)}$_n$—, wherein n is an integer from 2 to 20;

R$^1$ is independently, for each occurrence, a non-hydrogen or a substituted or unsubstituted side chain of an amino acid;

R$^2$ and R$^N$ are independently, for each occurrence, hydrogen, an organic group consisting of carbon, oxygen, nitrogen, sulfur, and hydrogen atoms, or any combination of the foregoing, and having from 1 to 20 carbon atoms, C$_{(1-5)}$alkyl, cycloalkyl, cycloalkylalkyl, C$_{(1-5)}$alkenyl, C$_{(1-5)}$alkynyl, C$_{(1-5)}$alkanoyl, C$_{(1-5)}$alkanoyloxy, C$_{(1-5)}$alkoxy, C$_{(1-5)}$alkoxy-C$_{(1-5)}$alkyl, C$_{(1-5)}$alkoxy-C$_{(1-5)}$alkoxy, C$_{(1-5)}$alkyl-amino-C$_{(1-5)}$alkyl-, C$_{(1-5)}$dialkyl-amino-C$_{(1-5)}$alkyl-, nitro-C$_{(1-5)}$alkyl, cyano-C$_{(1-5)}$alkyl, aryl-C$_{(1-5)}$alkyl, 4-biphenyl-C$_{(1-5)}$alkyl, carboxyl, or hydroxyl;

Z is —NH—, —O—, —S—, —CH$_2$S—, —CH$_2$S(O)—, or an organic linker consisting of 1-40 atoms selected from hydrogen, carbon, oxygen, nitrogen, and sulfur atoms (preferably, Z is —NH— or —O—);

R$^x$ and R$^y$ are, independently, (i) a lipophilic tail derived from a lipid (which can be naturally occurring or synthetic), e.g., a phospholipid, a glycolipid, a triacylglycerol, a glycerophospholipid, a sphingolipid, a ceramide, a sphingomyelin, a cerebroside, or a ganglioside, wherein the tail optionally includes a steroid; (ii) an amino acid terminal group selected from hydrogen, hydroxyl, amino, and an organic protecting group; or (iii) a substituted or unsubstituted C$_{(3-22)}$alkyl, C$_{(6-12)}$cycloalkyl, C$_{(6-12)}$cycloalkyl-C$_{(3-22)}$alkyl, C$_{(3-22)}$alkenyl, C$_{(3-22)}$alkynyl, C$_{(3-22)}$alkoxy, or C$_{(6-12)}$-alkoxy C$_{(3-22)}$alkyl;

In some embodiments, one of R$^x$ and R$^y$ is a lipophilic tail as defined above and the other is an amino acid terminal group. In some embodiments, both R$^x$ and R$^y$ are lipophilic tails.

In some embodiments, at least one of R$^x$ and R$^y$ is interrupted by one or more biodegradable groups (e.g., —OC(O)—, —C(O)O—, —SC(O)—, —C(O)S—, —OC(S)—, —C(S)O—, —S—S—, —C(O)(NR$^5$)—, —N(RS)C(O)—, —C(S)(NR$^5$)—, —N(RS)C(O)—, —N(RS)C(O)N(RS)—, —OC(O)O—, —OSi(R$^5$)$_2$O—, —C(O)(CR$^3$R$^4$)C(O)O—, —OC(O)(CR$^3$R$^4$)C(O)—, or

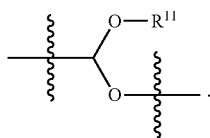

In some embodiments, $R^{11}$ is a $C_2$-$C_8$ alkyl or alkenyl.

In some embodiments, each occurrence of $R^5$ is, independently, H or alkyl.

In some embodiments, each occurrence of $R^3$ and $R^4$ are, independently H, halogen, OH, alkyl, alkoxy, —$NH_2$, alkylamino, or dialkylamino; or $R_3$ and $R_4$, together with the carbon atom to which they are directly attached, form a cycloalkyl group. In some particular embodiments, each occurrence of $R^3$ and $R^4$ are, independently H or $C_1$-$C_4$ alkyl.

In some embodiments, $R^x$ and $R^y$ each, independently, have one or more carbon-carbon double bonds.

In some embodiments, the cationic lipid is one of the following:

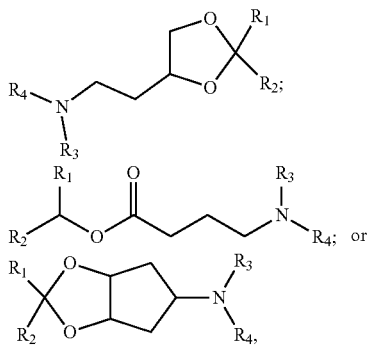

or a pharmaceutically acceptable salt, tautomer, prodrug or stereoisomer thereof, wherein:
  $R_1$ and $R_2$ are each independently alkyl, alkenyl, or alkynyl, each of which can optionally substituted;
  $R_3$ and $R_4$ are each independently a $C_1$-$C_6$ alkyl, or $R_3$ and $R_4$ are taken together to form an optionally substituted heterocyclic ring.

A representative useful dilinoleyl amino lipid has the formula:

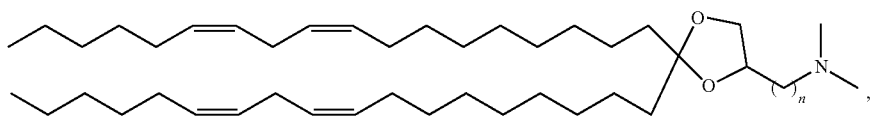

wherein n is 0, 1, 2, 3, or 4.

In one embodiment, a cationic lipid is DLin-K-DMA. In one embodiment, a cationic lipid is DLin-KC2-DMA (DLin-K-DMA above, wherein n is 2).

In one embodiment, a cationic lipid has the following structure:

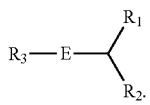

or a pharmaceutically acceptable salt, tautomer, prodrug or stereoisomer thereof, wherein:
  $R_1$ and $R_2$ are each independently for each occurrence optionally substituted $C_{10}$-$C_{30}$ alkyl, optionally substituted $C_{10}$-$C_{30}$ alkenyl, optionally substituted $C_{10}$-$C_{30}$ alkynyl or optionally substituted $C_{10}$-$C_{30}$ acyl;
  $R_3$ is H, optionally substituted $C_2$-$C_{10}$ alkyl, optionally substituted $C_2$-$C_{10}$ alkenyl, optionally substituted $C_2$-$C_{10}$ alkylyl, alkylhetrocycle, alkylpbosphate, alkylphosphorothioate, alkylphosphorodithioate, alkylphosphonate, alkylamine, hydroxyalkyl, ω-aminoalkyl, ω-(substituted)aminoalkyl, ω-phosphoalkyl, ω-thiophosphoalkyl, optionally substituted polyethylene glycol (PEG, mw 100-40K), optionally substituted mPEG (mw 120-40K), heteroaryl, or heterocycle, or a linker ligand, for example, in some embodiments, $R_3$ is $(CH_3)_2N(CH_2)_n$—, wherein n is 1, 2, 3 or 4;
  E is O, S, N(Q), C(O), OC(O), C(O)O, N(Q)C(O), C(O)N(Q), (Q)N(CO)O, O(CO)N(Q), S(O), NS(O)$_2$N(Q), S(O)$_2$, N(Q)S(O)$_2$, SS, O=N, aryl, heteroaryl, cyclic or heterocycle, for example —C(O)O, wherein—is a point of connection to $R_3$; and
  Q is H, alkyl, ω-aminoalkyl, ω-(substituted)aminoalkyl, co-phosphoalkyl or ω-thiophosphoalkyl.

In one specific embodiment, the cationic lipid of Embodiments 1, 2, 3, 4 or 5 has the following structure:

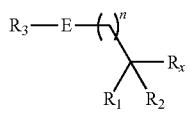

or a pharmaceutically acceptable salt, tautomer, prodrug or stereoisomer thereof, wherein:
  E is O, S, N(Q), C(O), N(Q)C(O), C(O)N(Q), (Q)N(CO) O, O(CO)N(Q), S(O), NS(O)$_2$N(Q), S(O)$_2$, N(Q)S(O)$_2$, SS, O=N, aryl, heteroaryl, cyclic or heterocycle;
  Q is H, alkyl, ω-aminoalkyl, ω-(substituted)aminoalkyl, ω-phosphoalkyl or ω-thiophosphoalkyl;
  $R_1$ and $R_2$ and $R_x$ are each independently for each occurrence H, optionally substituted $C_1$-$C_{10}$ alkyl, optionally substituted $C_{10}$-$C_{30}$ alkyl, optionally substituted $C_{10}$-$C_{30}$ alkenyl, optionally substituted $C_{10}$-$C_{30}$ alkynyl, optionally substituted $C_{10}$-$C_{30}$ acyl, or linker-ligand, provided that at least one of $R_1$, $R_2$ and $R_x$ is not H;
  $R_3$ is H, optionally substituted $C_1$-$C_{10}$ alkyl, optionally substituted $C_2$-$C_{10}$ alkenyl, optionally substituted $C_2$-$C_{10}$ alkynyl, alkylhetrocycle, alkylphosphate, alkylphosphorothioate, alkylphosphorodithioate, alkylphosphonate, alkylamine, hydroxyalkyl, ω-aminoalkyl, ω-(substituted)aminoalkyl, ω-phosphoalkyl, ω-thiophosphoalkyl, optionally substituted polyethylene glycol (PEG, mw 100-40K), optionally substituted mPEG (mw 120-40K), heteroaryl, or heterocycle, or linker-ligand; and n is 0, 1, 2, or 3.

In one embodiment, the cationic lipid of Embodiments 1, 2, 3, 4 or 5 has the structure of Formula I:

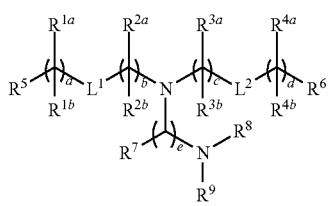

I or a pharmaceutically acceptable salt, tautomer, prodrug or stereoisomer thereof, wherein:

one of $L^1$ or $L^2$ is —O(C=O)—, —(C=O)O—, —C(=O)—, —O—, —S(O)$_x$—, —S—S—, —C(=O)S—, SC(=O)—, —NR$^a$C(=O)—, —C(=O)NR$^a$—, NR$^a$C(=O)NR$^a$—, —OC(=O)NR$^a$— or —NR$^a$C(=O)O—, and the other of $L^1$ or $L^2$ is —O(C=O)—, —(C=O)O—, —C(=O)—, —O—, —S(O)$_x$—, —S—S—, —C(=O)S—, SC(=O)—, —NR$^a$C(=O)—, —C(=O)NR$^a$—, NR$^a$C(=O) NR$^a$—, —OC(=O)NR$^a$— or —NR$^a$C(=O)O— or a direct bond;

$R^a$ is H or $C_1$-$C_{12}$ alkyl;

$R^{1a}$ and $R^{1b}$ are, at each occurrence, independently either (a) H or $C_1$-$C_{12}$ alkyl, or (b) $R^{1a}$ is H or $C_1$-$C_{12}$ alkyl, and $R^{1b}$ together with the carbon atom to which it is bound is taken together with an adjacent $R^{1b}$ and the carbon atom to which it is bound to form a carbon-carbon double bond;

$R^{2a}$ and $R^{2b}$ are, at each occurrence, independently either (a) H or $C_1$-$C_{12}$ alkyl, or (b) $R^{2a}$ is H or $C_1$-$C_{12}$ alkyl, and $R^{2b}$ together with the carbon atom to which it is bound is taken together with an adjacent $R^{2b}$ and the carbon atom to which it is bound to form a carbon-carbon double bond;

$R^{3a}$ and $R^{3b}$ are, at each occurrence, independently either (a) H or $C_1$-$C_{12}$ alkyl, or (b) $R^{3a}$ is H or $C_1$-$C_{12}$ alkyl, and $R^{3b}$ together with the carbon atom to which it is bound is taken together with an adjacent $R^{3b}$ and the carbon atom to which it is bound to form a carbon-carbon double bond;

$R^{4a}$ and $R^{4b}$ are, at each occurrence, independently either (a) H or $C_1$-$C_{12}$ alkyl, or (b) $R^{4a}$ is H or $C_1$-$C_{12}$ alkyl, and $R^{4b}$ together with the carbon atom to which it is bound is taken together with an adjacent $R^{4b}$ and the carbon atom to which it is bound to form a carbon-carbon double bond;

$R^5$ and $R^6$ are each independently methyl or cycloalkyl;

$R^7$ is, at each occurrence, independently H or $C_1$-$C_{12}$ alkyl;

$R^8$ and $R^9$ are each independently unsubstituted $C_1$-$C_{12}$ alkyl; or $R^8$ and $R^9$, together with the nitrogen atom to which they are attached, form a 5, 6 or 7-membered heterocyclic ring comprising one nitrogen atom;

a and d are each independently an integer from 0 to 24;

b and c are each independently an integer from 1 to 24;

e is 1 or 2; and x is 0, 1 or 2.

In some embodiments of Formula I, $L^1$ and $L^2$ are independently —O(C=O)— or —(C=O)O—.

In certain embodiments of Formula I, at least one of $R^{1a}$, $R^{2a}$, $R^{3a}$ or $R^{4a}$ is $C_1$-$C_{12}$ alkyl, or at least one of $L^1$ or $L^2$ is —O(C=O)— or —(C=O)O—. In other embodiments, $R^{1a}$ and $R^{1b}$ are not isopropyl when a is 6 or n-butyl when a is 8.

In still further embodiments of Formula I, at least one of $R^{1a}$, $R^{2a}$, $R^{3a}$ or $R^{4a}$ is $C_1$-$C_{12}$ alkyl, or at least one of $L^1$ or L2 is —O(C=O)— or —(C=O)O—; and $R^{1a}$ and $R^{1b}$ are not isopropyl when a is 6 or n-butyl when a is 8.

In other embodiments of Formula I, $R^8$ and $R^9$ are each independently unsubstituted $C_1$-$C_{12}$ alkyl; or $R^8$ and $R^9$, together with the nitrogen atom to which they are attached, form a 5, 6 or 7-membered heterocyclic ring comprising one nitrogen atom;

In certain embodiments of Formula I, any one of $L^1$ or $L^2$ may be —O(C=O)— or a carbon-carbon double bond. $L^1$ and $L^2$ may each be —O(C=O)— or may each be a carbon-carbon double bond.

In some embodiments of Formula I, one of $L^1$ or $L^2$ is —O(C=O)—. In other embodiments, both $L^1$ and $L^2$ are —O(C=O)—.

In some embodiments of Formula I, one of $L^1$ or $L^2$ is —(C=O)O—. In other embodiments, both $L^1$ and $L^2$ are —(C=O)O—.

In some other embodiments of Formula I, one of L or $L^2$ is a carbon-carbon double bond. In other embodiments, both $L^1$ and $L^2$ are a carbon-carbon double bond.

In still other embodiments of Formula I, one of $L^1$ or $L^2$ is —O(C=O)— and the other of L or L2 is —(C=O)O—. In more embodiments, one of $L^1$ or $L^2$ is —O(C=O)— and the other of $L^1$ or $L^2$ is a carbon-carbon double bond. In yet more embodiments, one of $L^1$ or $L^2$ is —(C=O)O— and the other of $L^1$ or $L^2$ is a carbon-carbon double bond.

It is understood that "carbon-carbon" double bond, as used throughout the specification, refers to one of the following structures:

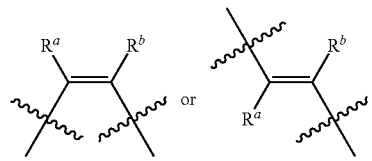

wherein $R^a$ and $R^b$ are, at each occurrence, independently H or a substituent. For example, in some embodiments $R^a$ and $R^b$ are, at each occurrence, independently H, $C_1$-$C_{12}$ alkyl or cycloalkyl, for example H or $C_1$-$C_{12}$ alkyl.

In other embodiments, the lipid compounds of Formula I have the following Formula (Ia):

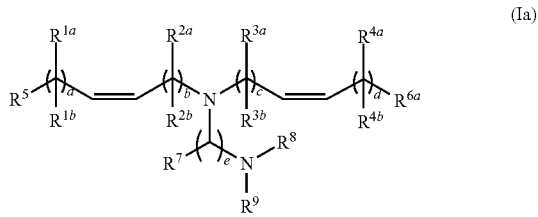

(Ia)

In other embodiments, the lipid compounds of Formula I have the following Formula (Ib):

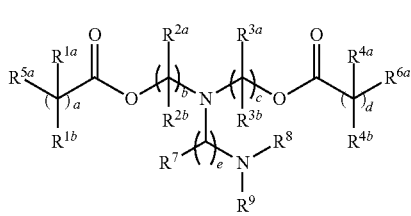

(Ib)

In yet other embodiments, the lipid compounds of Formula I have the following Formula (Ic):

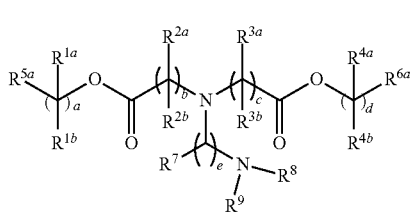

(Ic)

In certain embodiments of the lipid compound of Formula I, a, b, c and d are each independently an integer from 2 to 12 or an integer from 4 to 12. In other embodiments, a, b, c and d are each independently an integer from 8 to 12 or 5 to 9. In some certain embodiments, a is 0. In some embodiments, a is 1. In other embodiments, a is 2. In more embodiments, a is 3. In yet other embodiments, a is 4. In some embodiments, a is 5. In other embodiments, a is 6. In more embodiments, a is 7. In yet other embodiments, a is 8. In some embodiments, a is 9. In other embodiments, a is 10. In more embodiments, a is 11. In yet other embodiments, a is 12. In some embodiments, a is 13. In other embodiments, a is 14. In more embodiments, a is 15. In yet other embodiments, a is 16.

In some other embodiments of Formula I, b is 1. In other embodiments, b is 2. In more embodiments, b is 3. In yet other embodiments, b is 4. In some embodiments, b is 5. In other embodiments, b is 6. In more embodiments, b is 7. In yet other embodiments, b is 8. In some embodiments, b is 9. In other embodiments, b is 10. In more embodiments, b is 11. In yet other embodiments, b is 12. In some embodiments, b is 13. In other embodiments, b is 14. In more embodiments, b is 15. In yet other embodiments, b is 16.

In some more embodiments of Formula I, c is 1. In other embodiments, c is 2. In more embodiments, c is 3. In yet other embodiments, c is 4. In some embodiments, c is 5. In other embodiments, c is 6. In more embodiments, c is 7. In yet other embodiments, c is 8. In some embodiments, c is 9. In other embodiments, c is 10. In more embodiments, c is 11. In yet other embodiments, c is 12. In some embodiments, c is 13. In other embodiments, c is 14. In more embodiments, c is 15. In yet other embodiments, c is 16.

In some certain other embodiments of Formula I, d is 0. In some embodiments, d is 1. In other embodiments, d is 2. In more embodiments, d is 3. In yet other embodiments, d is 4. In some embodiments, d is 5. In other embodiments, d is 6. In more embodiments, d is 7. In yet other embodiments, d is 8. In some embodiments, d is 9. In other embodiments, d is 10. In more embodiments, d is 11. In yet other embodiments, d is 12. In some embodiments, d is 13. In other embodiments, d is 14. In more embodiments, d is 15. In yet other embodiments, d is 16.

In some other various embodiments of Formula I, a and d are the same. In some other embodiments, b and c are the same. In some other specific embodiments, a and d are the same and b and c are the same.

The sum of a and b and the sum of c and d in Formula I are factors which may be varied to obtain a lipid of formula I having the desired properties. In one embodiment, a and b are chosen such that their sum is an integer ranging from 14 to 24. In other embodiments, c and d are chosen such that their sum is an integer ranging from 14 to 24. In further embodiment, the sum of a and b and the sum of c and d are the same. For example, in some embodiments the sum of a and b and the sum of c and d are both the same integer which may range from 14 to 24. In still more embodiments, a. b, c and d are selected such the sum of a and b and the sum of c and d is 12 or greater.

In some embodiments of Formula I, e is 1. In other embodiments, e is 2.

The substituents at $R^{1a}$, $R^{2a}$, $R^{3a}$ and $R^{4a}$ of Formula I are not particularly limited. In certain embodiments $R^{1a}$, $R^{2a}$, $R^{3a}$ and $R^{4a}$ are H at each occurrence. In certain other embodiments at least one of $R^{1a}$, $R^{2a}$, $R^{3a}$ and $R^{4a}$ is $C_1$-$C_{12}$ alkyl. In certain other embodiments at least one of $R^{1a}$, $R^{2a}$, $R^{3a}$ and $R^{4a}$ is $C_1$-$C_8$ alkyl. In certain other embodiments at least one of $R^{1a}$, $R^{2a}$, $R^{3a}$ and $R^{4a}$ is $C_1$-$C_6$ alkyl. In some of the foregoing embodiments, the $C_1$-$C_8$ alkyl is methyl, ethyl, n-propyl, iso-propyl, n-butyl, iso-butyl, tert-butyl, n-hexyl or n-octyl.

In certain embodiments of Formula I, $R^{1a}$, $R^{1b}$, $R^{4a}$ and $R^{4b}$ are $C_1$-$C_{12}$ alkyl at each occurrence.

In further embodiments of Formula I, at least one of $R^{1b}$, $R^{2b}$, $R^{3b}$ and $R^{4b}$ is H or $R^{1b}$, $R^{2b}$, $R^{3b}$ and $R^{4b}$ are H at each occurrence.

In certain embodiments of Formula I, $R^{1b}$ together with the carbon atom to which it is bound is taken together with an adjacent $R^{1b}$ and the carbon atom to which it is bound to form a carbon-carbon double bond. In other embodiments of the foregoing $R^{4b}$ together with the carbon atom to which it is bound is taken together with an adjacent $R_4^b$ and the carbon atom to which it is bound to form a carbon-carbon double bond.

The substituents at $R^5$ and $R^6$ of Formula I are not particularly limited in the foregoing embodiments. In certain embodiments one or both of $R^5$ or $R_6$ is methyl. In certain other embodiments one or both of $R^5$ or $R^6$ is cycloalkyl for example cyclohexyl. In these embodiments the cycloalkyl may be substituted or not substituted. In certain other embodiments the cycloalkyl is substituted with $C_1$-$C_{12}$ alkyl, for example tert-butyl.

The substituents at $R^7$ are not particularly limited in the foregoing embodiments of Formula I. In certain embodiments at least one $R^7$ is H. In some other embodiments, $R^7$ is H at each occurrence. In certain other embodiments $R^7$ is $C_1$-$C_{12}$ alkyl.

In certain other of the foregoing embodiments of Formula I, one of $R^8$ or $R^9$ is methyl. In other embodiments, both $R^8$ and $R^9$ are methyl.

In some different embodiments of Formula I, $R^8$ and $R^9$, together with the nitrogen atom to which they are attached, form a 5, 6 or 7-membered heterocyclic ring. In some embodiments of the foregoing, $R^8$ and $R^9$, together with the nitrogen atom to which they are attached, form a 5-membered heterocyclic ring, for example a pyrrolidinyl ring.

In some embodiments of Embodiment 3, the first and second cationic lipids are each, independently selected from a lipid of Formula I.

In various different embodiments, the lipid of Formula I has one of the structures set forth in Table 1 below.

TABLE 1

Representative Lipids of Formula I

| No. | Structure | pKa |
|---|---|---|
| I-1 | 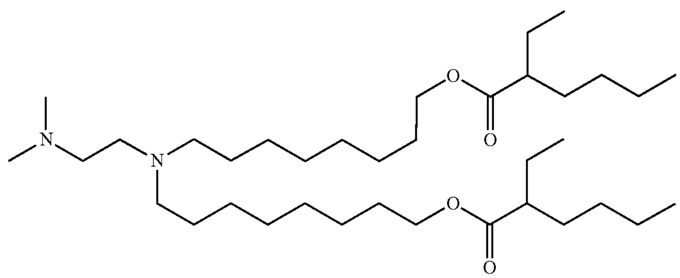 [SMILES: CCCCC(CC)C(=O)OCCCCCCCCN(CCCCCCCCOC(=O)C(CC)CCCC)CCN(C)C] | — |
| I-2 | 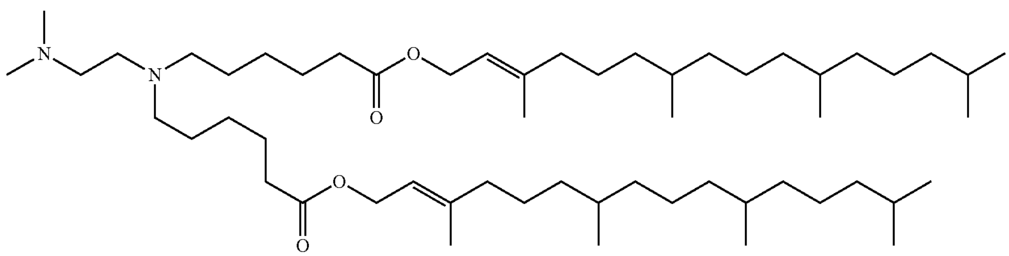 [SMILES: C/C(=C\COC(=O)CCCCCN(CCCCCC(=O)OC/C=C(\C)CCCC(C)CCCC(C)CCCC(C)C)CCN(C)C)CCCC(C)CCCC(C)CCCC(C)C] | 5.64 |
| I-3 | 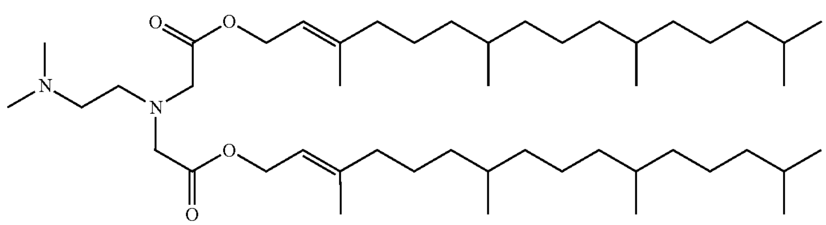 [SMILES: C/C(=C\COC(=O)CN(CCN(C)C)CC(=O)OC/C=C(\C)CCCC(C)CCCC(C)CCCC(C)C)CCCC(C)CCCC(C)CCCC(C)C] | 7.15 |
| I-4 | 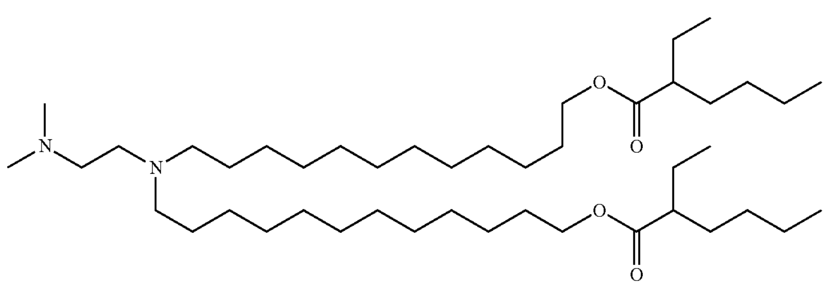 [SMILES: CCCCC(CC)C(=O)OCCCCCCCCCCCCN(CCCCCCCCCCCCOC(=O)C(CC)CCCC)CCN(C)C] | 6.43 |
| I-5 | 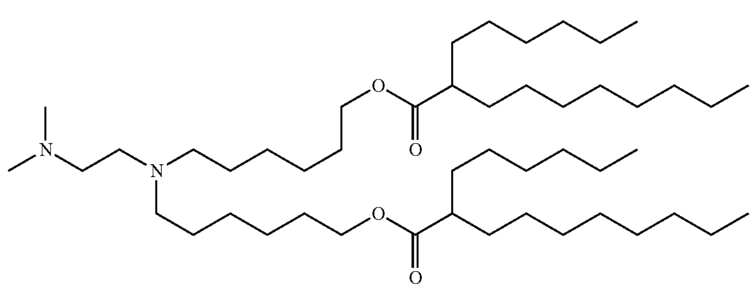 [SMILES: CCCCCCCCC(CCCCCC)C(=O)OCCCCCCN(CCCCCCOC(=O)C(CCCCCC)CCCCCCCC)CCN(C)C] | 6.28 |

TABLE 1-continued

Representative Lipids of Formula I

| No. | Structure | pKa |
|---|---|---|
| I-6 | 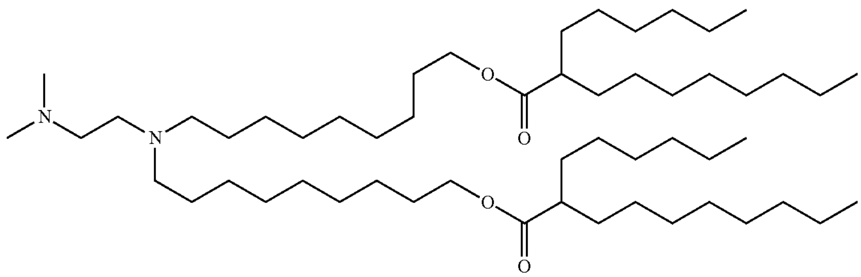 [SMILES: CCCCCCCCC(CCCCCC)C(=O)OCCCCCCCCCN(CCCCCCCCCOC(=O)C(CCCCCC)CCCCCCCC)CCN(C)C] | 6.12 |
| I-7 | 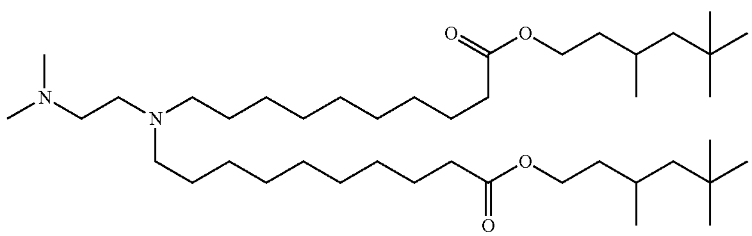 [SMILES: CC(CCOC(=O)CCCCCCCCCN(CCCCCCCCCC(=O)OCCC(C)CC(C)(C)C)CCN(C)C)CC(C)(C)C] | — |
| I-8 | 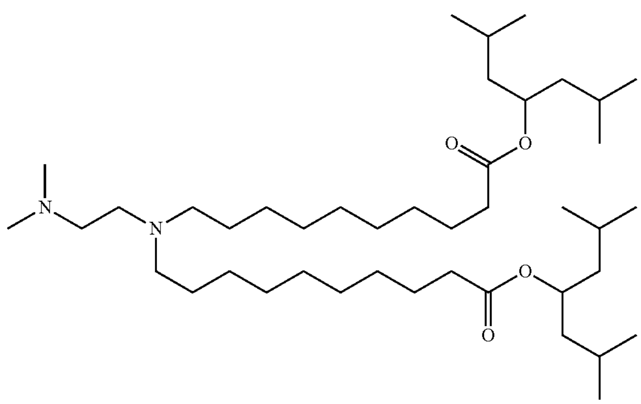 [SMILES: CC(C)CC(CC(C)C)OC(=O)CCCCCCCCCN(CCCCCCCCCC(=O)OC(CC(C)C)CC(C)C)CCN(C)C] | — |
| I-9 | 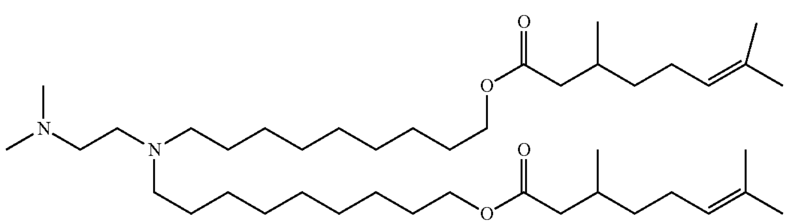 [SMILES: CC(C)=CCCC(C)CC(=O)OCCCCCCCCCN(CCCCCCCCCOC(=O)CC(C)CCC=C(C)C)CCN(C)C] | — |
| I-10 | 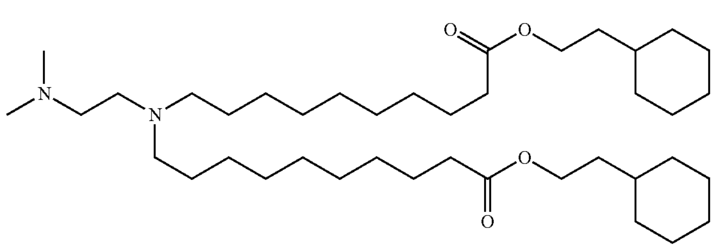 [SMILES: CN(C)CCN(CCCCCCCCCC(=O)OCCC1CCCCC1)CCCCCCCCCC(=O)OCCC1CCCCC1] | — |

TABLE 1-continued

| | Representative Lipids of Formula I | |
|---|---|---|
| No. | Structure | pKa |
| I-11 | | 6.36 |
| I-12 | | — |
| I-13 | | 6.51 |
| I-14 | | — |
| I-15 | | 6.30 |
| I-16 | | 6.63 |

TABLE 1-continued
Representative Lipids of Formula I
| No. | Structure | pKa |
|---|---|---|
| I-17 | 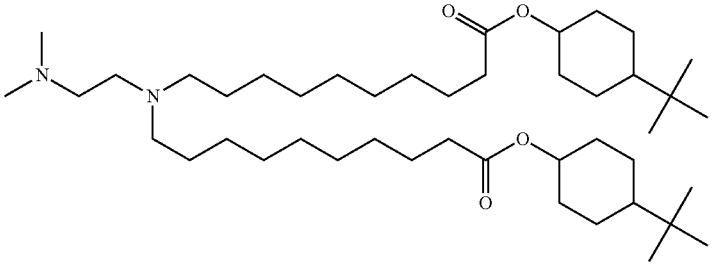 [SMILES: CN(C)CCN(CCCCCCCCCC(=O)OC1CCC(C(C)(C)C)CC1)CCCCCCCCCC(=O)OC1CCC(C(C)(C)C)CC1] | — |
| I-18 | 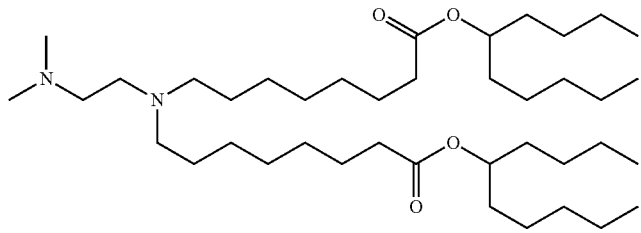 [SMILES: CCCCCC(CCCC)OC(=O)CCCCCCCN(CCCCCCCC(=O)OC(CCCC)CCCCC)CCN(C)C] | — |
| I-19 | 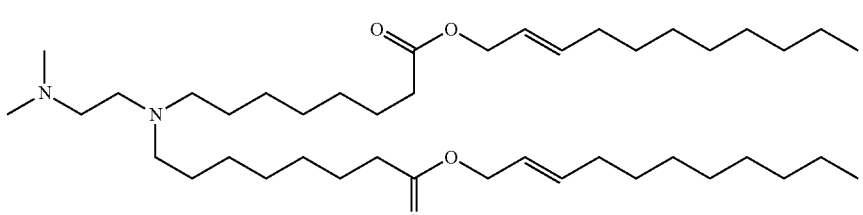 | 6.72 |
| I-20 | 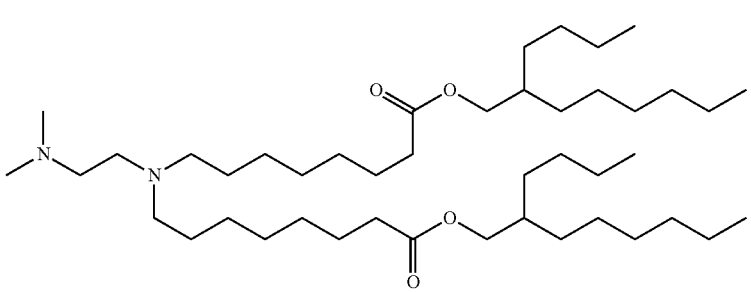 [SMILES: CCCCCCC(CCCC)COC(=O)CCCCCCCN(CCCCCCCC(=O)OCC(CCCC)CCCCCC)CCN(C)C] | 6.44 |
| I-21 | 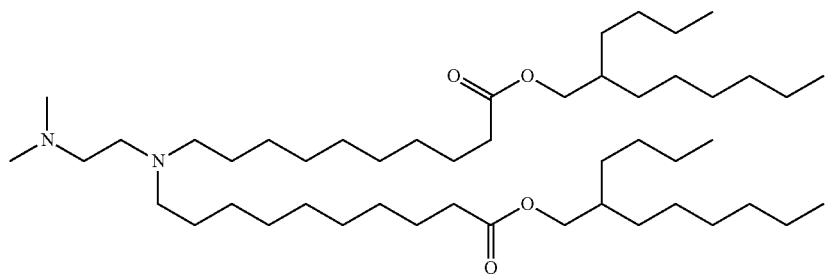 [SMILES: CCCCCCC(CCCC)COC(=O)CCCCCCCCCN(CCCCCCCCCC(=O)OCC(CCCC)CCCCCC)CCN(C)C] | 6.28 |
| I-22 | 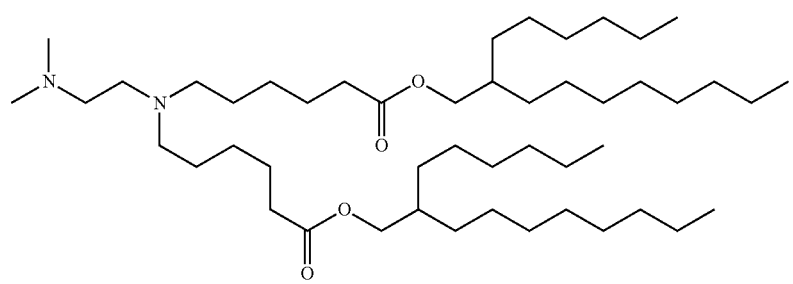 [SMILES: CCCCCCCCC(CCCCCC)COC(=O)CCCCCN(CCCCCC(=O)OCC(CCCCCC)CCCCCCCC)CCN(C)C] | 6.53 |

TABLE 1-continued

Representative Lipids of Formula I

| No. | Structure | pKa |
|---|---|---|
| I-23 | 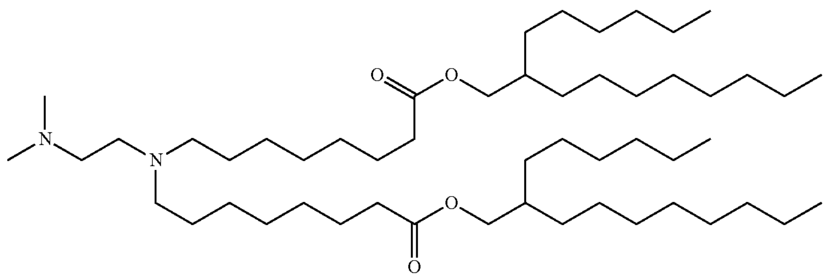 [SMILES: CCCCCCCCC(CCCCCC)COC(=O)CCCCCCCN(CCCCCCCC(=O)OCC(CCCCCC)CCCCCCCC)CCN(C)C] | 6.24 |
| I-24 | 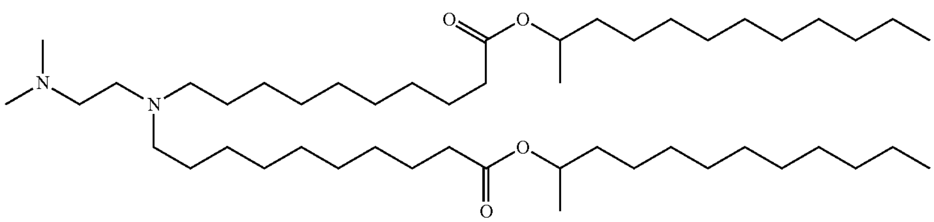 [SMILES: CCCCCCCCCCC(C)OC(=O)CCCCCCCCCN(CCCCCCCCCC(=O)OC(C)CCCCCCCCCC)CCN(C)C] | 6.28 |
| I-25 | 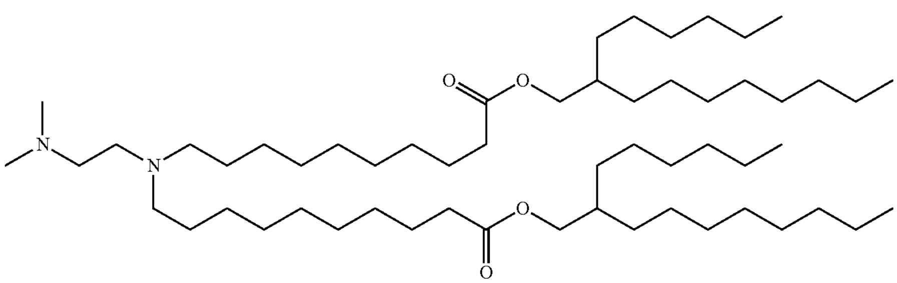 [SMILES: CCCCCCCCC(CCCCCC)COC(=O)CCCCCCCCCN(CCCCCCCCCC(=O)OCC(CCCCCC)CCCCCCCC)CCN(C)C] | 6.20 |
| I-33 | 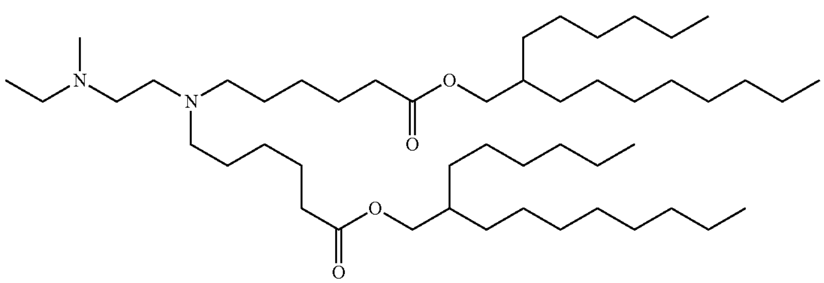 [SMILES: CCCCCCCCC(CCCCCC)COC(=O)CCCCCN(CCCCCC(=O)OCC(CCCCCC)CCCCCCCC)CCN(C)CC] | 6.27 |
| I-34 | 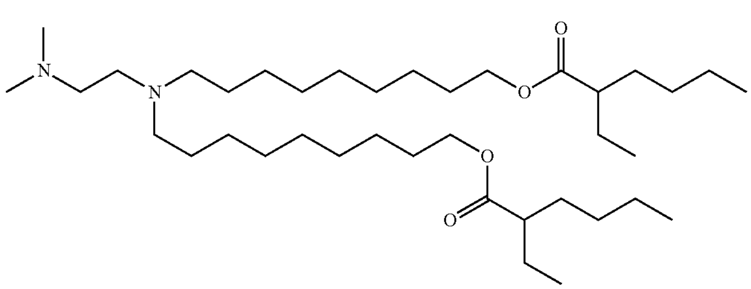 [SMILES: CCCCC(CC)C(=O)OCCCCCCCCCN(CCCCCCCCCOC(=O)C(CC)CCCC)CCN(C)C] | — |

TABLE 1-continued

Representative Lipids of Formula I

| No. | Structure | pKa |
|---|---|---|
| I-35 | 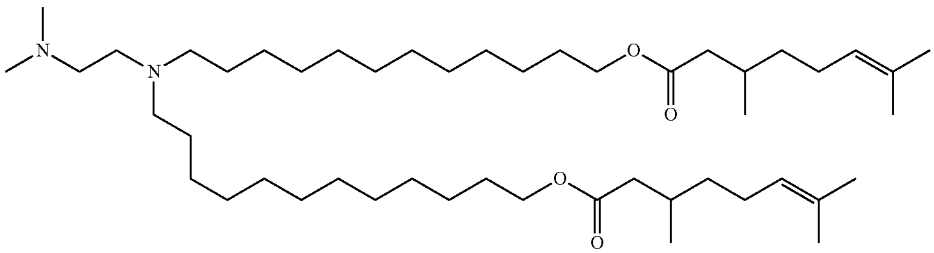 [SMILES: CC(C)=CCCC(C)CC(=O)OCCCCCCCCCCCCN(CCCCCCCCCCCCOC(=O)CC(C)CCC=C(C)C)CCN(C)C] | 6.21 |
| I-36 | 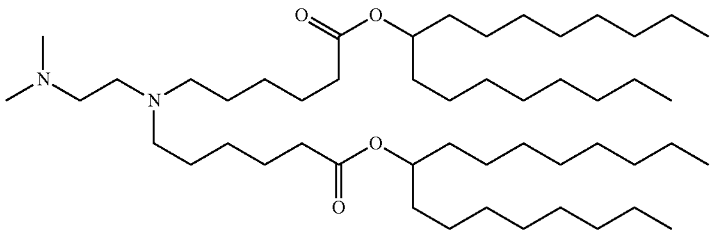 [SMILES: CCCCCCCCC(CCCCCCCC)OC(=O)CCCCCN(CCCCCC(=O)OC(CCCCCCCC)CCCCCCCC)CCN(C)C] | — |
| I-37 | 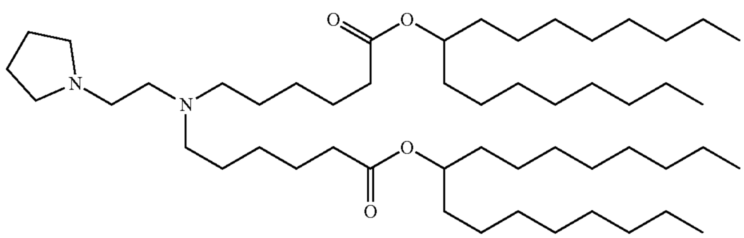 [SMILES: CCCCCCCCC(CCCCCCCC)OC(=O)CCCCCN(CCCCCC(=O)OC(CCCCCCCC)CCCCCCCC)CCN1CCCC1] | — |
| I-38 | 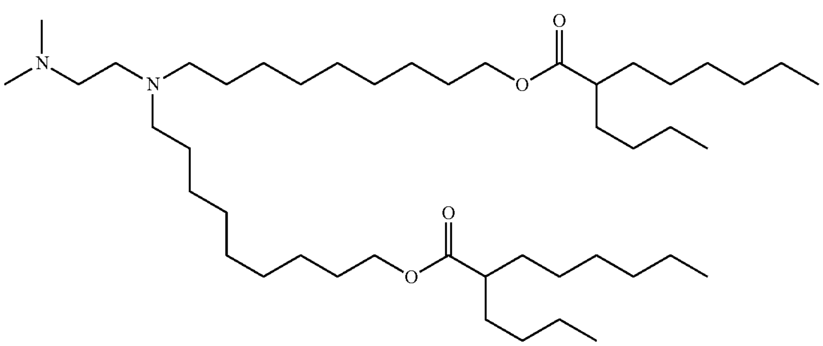 [SMILES: CCCCCCC(CCCC)C(=O)OCCCCCCCCCN(CCCCCCCCCOC(=O)C(CCCC)CCCCCC)CCN(C)C] | 6.24 |
| I-39 | 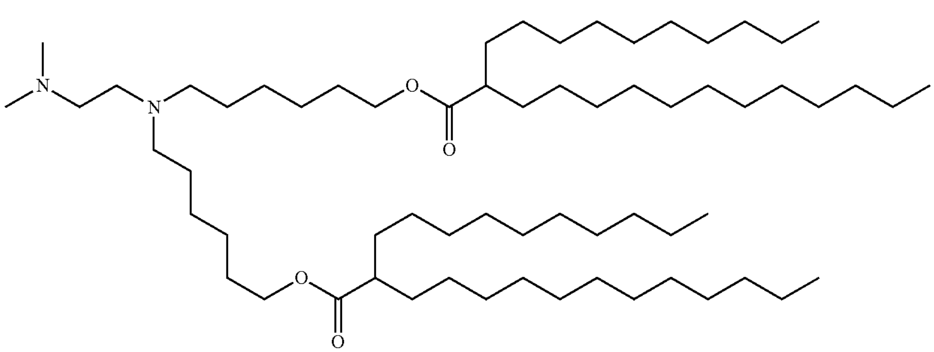 [SMILES: CCCCCCCCCCCCC(CCCCCCCCCC)C(=O)OCCCCCCN(CCCCCCOC(=O)C(CCCCCCCCCC)CCCCCCCCCCCC)CCN(C)C] | 5.82 |

TABLE 1-continued

Representative Lipids of Formula I

| No. | Structure | pKa |
|---|---|---|
| I-40 | 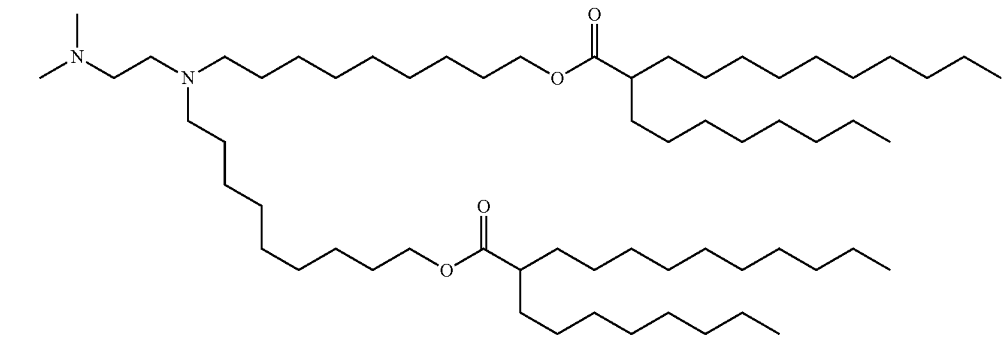 [SMILES: CCCCCCCCCCC(CCCCCCCC)C(=O)OCCCCCCCCCN(CCCCCCCCCOC(=O)C(CCCCCCCC)CCCCCCCCCC)CCN(C)C] | 6.38 |
| I-41 | 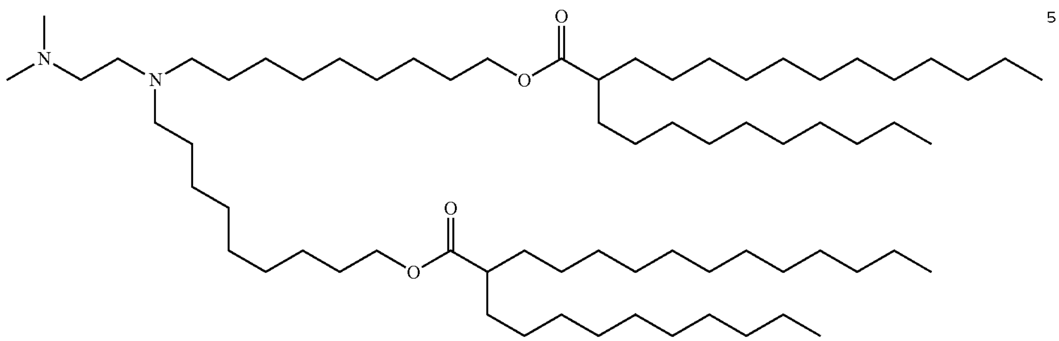 | 5.91 |

In some embodiments, the cationic lipid of Embodiments 1, 2, 3, 4 or 5 has a structure of Formula IL:

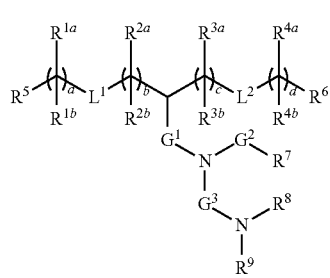

II or a pharmaceutically acceptable salt, tautomer, prodrug or stereoisomer thereof, wherein:

one of $L^1$ or $L^2$ is —O(C=O)—, —(C=O)O—, —C(=O)—, —O—, —S(O)$_x$—, —S—S—, —C(=O)S—, SC(=O)—, —NR$^a$C(=O)—, —C(=O)NR$^a$—, NR$^a$C(=O)NR$^a$—, —OC(=O)NR$^a$— or —NR$^a$C(=O)O—, and the other of $L^1$ or $L^2$ is —O(C=O)—, —(C=O)O—, —C(=O)—, —O—, —S(O)$_x$—, —S—S—, —C(=O)S, SC(=O)—, NR$^a$C(=O)—, —C(=O)NR$^a$—, NR$^a$C(=O)NR$^a$—, —OC(=O)NR$^a$— or —NR$^a$C(=O)O— or a direct bond;

$G^1$ is $C_1$-$C_2$ alkylene, —(C=O)—, —O(C=O)—, —SC(=O)—, —NR$^a$C(=O)— or a direct bond;

$G^2$ is —C(=O)—, —(C=O)O—, —C(=O)S—, —C(=O)NR$^a$— or a direct bond;

$G^3$ is $C_1$-$C_6$ alkylene;

$R^a$ is H or $C_1$-$C_{12}$ alkyl;

$R^{1a}$ and $R^{1b}$ are, at each occurrence, independently either:
(a) H or $C_1$-$C_{12}$ alkyl; or (b) $R^{1a}$ is H or $C_1$-$C_{12}$ alkyl, and $R^{1b}$ together with the carbon atom to which it is bound is taken together with an adjacent $R^{1b}$ and the carbon atom to which it is bound to form a carbon-carbon double bond;

$R^{2a}$ and $R^{2b}$ are, at each occurrence, independently either:
(a) H or $C_1$-$C_{12}$ alkyl; or (b) $R^{2a}$ is H or $C_1$-$C_2$ alkyl, and $R^{2b}$ together with the carbon atom to which it is bound is taken together with an adjacent $R^{2b}$ and the carbon atom to which it is bound to form a carbon-carbon double bond;

$R^{3a}$ and $R^{3b}$ are, at each occurrence, independently either
(a): H or $C_1$-$C_2$ alkyl; or (b) $R^{3a}$ is H or $C_1$-$C_{12}$ alkyl, and $R^{3b}$ together with the carbon atom to which it is bound is taken together with an adjacent $R^{3b}$ and the carbon atom to which it is bound to form a carbon-carbon double bond;

$R^{4a}$ and $R^{4b}$ are, at each occurrence, independently either:
(a) H or $C_1$-$C_{12}$ alkyl; or (b) $R^{4a}$ is H or $C_1$-$C_{12}$ alkyl, and $R^{4b}$ together with the carbon atom to which it is bound is taken together with an adjacent $R^{4b}$ and the carbon atom to which it is bound to form a carbon-carbon double bond;

$R^5$ and $R^6$ are each independently H or methyl;

$R^7$ is $C_4$-$C_{20}$ alkyl;

$R^8$ and $R^9$ are each independently $C_1$-$C_{12}$ alkyl; or $R^8$ and $R^9$, together with the nitrogen atom to which they are attached, form a 5, 6 or 7-membered heterocyclic ring;

a, b, c and d are ach independently an integer from 1 to 24 and x is 0, 1 or 2.

In some embodiments of Formula (II), $L^1$ and $L^2$ are each independently —O(C=O)—, —(C=O)O— or a direct bond. In other embodiments, $G^1$ and $G^2$ are each independently —(C=O)— or a direct bond. In some different embodiments, $L^1$ and $L^2$ are each independently —O(C=O)—, —(C=O)O— or a direct bond; and $G^1$ and $G^2$ are each independently —(C=O)— or a direct bond.

In some different embodiments of Formula (II), $L^1$ and $L^2$ are each independently —C(=O)—, —O—, —S(O)$_x$—, —S—S—, —C(=O)S—, —SC(=O)—, —NR$^a$—, —NR$^a$C(=O)—, —C(=O)NR$^a$—, —NR$^a$C(=O)NR$^a$, —OC(=O)NR$^a$—, —NR$^a$C(=O)O—, —NR$^a$S(O)$_x$NR$^a$—, —NR$^a$S(O)$_x$— or —S(O)$_x$NR$^a$—.

In other of the foregoing embodiments of Formula (II), the lipid compound has one of the following Formulae (IIA) or (IIB):

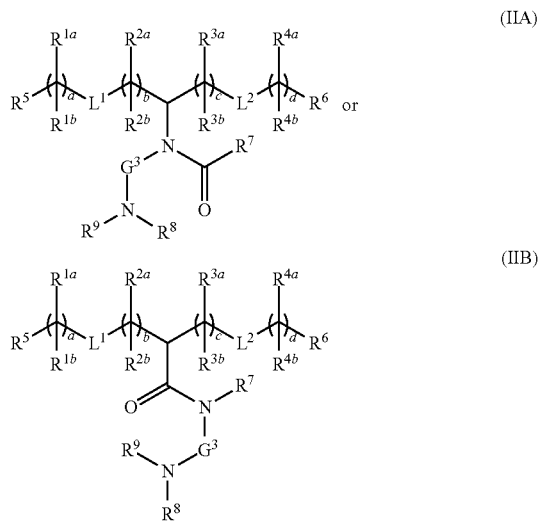

In some embodiments of Formula (II), the lipid compound has Formula (IIA). In other embodiments, the lipid compound has Formula (IIB).

In any of the foregoing embodiments of Formula (II), one of $L^1$ or $L^2$ is —O(C=O)—. For example, in some embodiments each of $L^1$ and $L^2$ are —O(C=O)—.

In some different embodiments of Formula (II), one of $L^1$ or $L^2$ is —(C=O)O—. For example, in some embodiments each of $L^1$ and $L^2$ is —(C=O)O—.

In different embodiments of Formula (II), one of $L^1$ or $L^2$ is a direct bond. As used herein, a "direct bond" means the group (e.g., $L^1$ or $L^2$) is absent. For example, in some embodiments each of $L^1$ and $L^2$ is a direct bond.

In other different embodiments of Formula (II), for at least one occurrence of $R^{1a}$ and $R^{1b}$, $R^{1a}$ is H or $C_1$-$C_{12}$ alkyl, and $R^{1b}$ together with the carbon atom to which it is bound is taken together with an adjacent $R^{1b}$ and the carbon atom to which it is bound to form a carbon-carbon double bond.

In still other different embodiments of Formula (II), for at least one occurrence of $R^{4a}$ and $R^{4b}$, $R^{4a}$ is H or $C_1$-$C_{12}$ alkyl, and $R^{4b}$ together with the carbon atom to which it is bound is taken together with an adjacent $R^{4b}$ and the carbon atom to which it is bound to form a carbon-carbon double bond.

In more embodiments of Formula (II), for at least one occurrence of $R^{2a}$ and $R^{2b}$, $R^{2a}$ is H or $C_1$-$C_{12}$ alkyl, and $R^{2b}$ together with the carbon atom to which it is bound is taken together with an adjacent $R^{2b}$ and the carbon atom to which it is bound to form a carbon-carbon double bond.

In other different embodiments of Formula (II), for at least one occurrence of $R^{3a}$ and $R^{3b}$, $R^{3a}$ is H or $C_1$-$C_{12}$ alkyl, and $R^{3b}$ together with the carbon atom to which it is bound is taken together with an adjacent $R^{3b}$ and the carbon atom to which it is bound to form a carbon-carbon double bond.

In various other embodiments of Formula (II), the lipid compound has one of the following Formulae (IIC) or (IID):

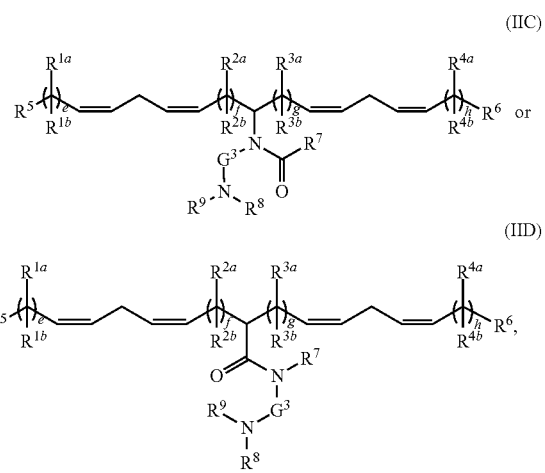

wherein e, f, g and h are each independently an integer from 1 to 12.

In some embodiments of Formula (II), the lipid compound has Formula (IIC). In other embodiments, the lipid compound has Formula (IID).

In various embodiments of Formulae (IIC) or (IID), e, f, g and h are each independently an integer from 4 to 10.

In certain embodiments of Formula (II), a, b, c and d are each independently an integer from 2 to 12 or an integer from 4 to 12. In other embodiments, a, b, c and d are each independently an integer from 8 to 12 or 5 to 9. In some certain embodiments, a is 0. In some embodiments, a is 1. In other embodiments, a is 2. In more embodiments, a is 3. In yet other embodiments, a is 4. In some embodiments, a is 5. In other embodiments, a is 6. In more embodiments, a is 7. In yet other embodiments, a is 8. In some embodiments, a is 9. In other embodiments, a is 10. In more embodiments, a is 11. In yet other embodiments, a is 12. In some embodiments, a is 13. In other embodiments, a is 14. In more embodiments, a is 15. In yet other embodiments, a is 16.

In some embodiments of Formula (II), b is 1. In other embodiments, b is 2. In more embodiments, b is 3. In yet other embodiments, b is 4. In some embodiments, b is 5. In other embodiments, b is 6. In more embodiments, b is 7. In yet other embodiments, b is 8. In some embodiments, b is 9. In other embodiments, b is 10. In more embodiments, b is 11. In yet other embodiments, b is 12. In some embodiments, b is 13. In other embodiments, b is 14. In more embodiments, b is 15. In yet other embodiments, b is 16.

In some embodiments of Formula (II), c is 1. In other embodiments, c is 2. In more embodiments, c is 3. In yet other embodiments, c is 4. In some embodiments, c is 5. In other embodiments, c is 6. In more embodiments, c is 7. In yet other embodiments, c is 8. In some embodiments, c is 9. In other embodiments, c is 10. In more embodiments, c is 11. In yet other embodiments, c is 12. In some embodiments, c is 13. In other embodiments, c is 14. In more embodiments, c is 15. In yet other embodiments, c is 16.

In some certain embodiments of Formula (II), d is 0. In some embodiments, d is 1. In other embodiments, d is 2. In more embodiments, d is 3. In yet other embodiments, d is 4. In some embodiments, d is 5. In other embodiments, d is 6.

In more embodiments, d is 7. In yet other embodiments, d is 8. In some embodiments, d is 9. In other embodiments, d is 10. In yet other embodiments, d is 11. In yet other embodiments, d is 12. In some embodiments, d is 13. In other embodiments, d is 14. In more embodiments, d is 15. In yet other embodiments, d is 16.

In some embodiments of Formula (II), e is 1. In other embodiments, e is 2. In more embodiments, e is 3. In yet other embodiments, e is 4. In some embodiments, e is 5. In other embodiments, e is 6. In more embodiments, e is 7. In yet other embodiments, e is 8. In some embodiments, e is 9. In other embodiments, e is 10. In more embodiments, e is 11. In yet other embodiments, e is 12.

In some embodiments of Formula (II), f is 1. In other embodiments, f is 2. In more embodiments, f is 3. In yet other embodiments, f is 4. In some embodiments, f is 5. In other embodiments, f is 6. In more embodiments, f is 7. In yet other embodiments, f is 8. In some embodiments, f is 9. In other embodiments, f is 10. In more embodiments, f is 11. In yet other embodiments, f is 12.

In some embodiments of Formula (II), g is 1. In other embodiments, g is 2. In more embodiments, g is 3. In yet other embodiments, g is 4. In some embodiments, g is 5. In other embodiments, g is 6. In more embodiments, g is 7. In yet other embodiments, g is 8. In some embodiments, g is 9. In other embodiments, g is 10. In more embodiments, g is 11. In yet other embodiments, g is 12.

In some embodiments of Formula (II), h is 1. In other embodiments, e is 2. In more embodiments, h is 3. In yet other embodiments, h is 4. In some embodiments, e is 5. In other embodiments, h is 6. In more embodiments, h is 7. In yet other embodiments, h is 8. In some embodiments, h is 9. In other embodiments, h is 10. In more embodiments, h is 11. In yet other embodiments, h is 12.

In some other various embodiments of Formula (II), a and d are the same. In some other embodiments, b and c are the same. In some other specific embodiments and a and d are the same and b and c are the same.

The sum of a and b and the sum of c and d of Formula (II) are factors which may be varied to obtain a lipid having the desired properties. In one embodiment, a and b are chosen such that their sum is an integer ranging from 14 to 24. In other embodiments, c and d are chosen such that their sum is an integer ranging from 14 to 24. In further embodiment, the sum of a and b and the sum of c and d are the same. For example, in some embodiments the sum of a and b and the sum of c and d are both the same integer which may range from 14 to 24. In still more embodiments, a. b, c and d are selected such that the sum of a and b and the sum of c and d is 12 or greater.

The substituents at $R^{1a}$, $R^{2a}$, $R^{3a}$ and $R^{4a}$ of Formula (II) are not particularly limited. In some embodiments, at least one of $R^{1a}$, $R^{2a}$, $R^{3a}$ and $R^{4a}$ is H. In certain embodiments $R^{1a}$, $R^{2a}$, $R^{3a}$ and $R^{4a}$ are H at each occurrence. In certain other embodiments at least one of $R^{1a}$, $R^{2a}$, $R^{3a}$ and $R^{4a}$ is $C_1$-$C_{12}$ alkyl. In certain other embodiments at least one of $R^{1a}$, $R^{2a}$, $R^{3a}$ and $R^{4a}$ is $C_1$-$C_8$ alkyl. In certain other embodiments at least one of $R^{1a}$, $R^{2a}$, $R^{3a}$ and $R^{4a}$ is $C_1$-$C_6$ alkyl. In some of the foregoing embodiments, the $C_1$-$C_8$ alkyl is methyl, ethyl, n-propyl, iso-propyl, n-butyl, iso-butyl, tert-butyl, n-hexyl or n-octyl.

In certain embodiments of Formula (II), $R^{1a}$, $R^{1b}$, $R^{4a}$ and $R^{4b}$ are $C_1$-$C_{12}$ alkyl at each occurrence.

In further embodiments of Formula (II), at least one of $R^{1b}$, $R^{2b}$, $R^{3b}$ and $R^{4b}$ is H or $R^{1b}$, $R^{2b}$, $R^{3b}$ and $R^{4b}$ are H at each occurrence.

In certain embodiments of Formula (II), $R^{1b}$ together with the carbon atom to which it is bound is taken together with an adjacent $R^{1b}$ and the carbon atom to which it is bound to form a carbon-carbon double bond. In other embodiments of the foregoing $R_4^b$ together with the carbon atom to which it is bound is taken together with an adjacent $R_4^b$ and the carbon atom to which it is bound to form a carbon-carbon double bond.

The substituents at $R^5$ and $R^6$ of Formula (II) are not particularly limited in the foregoing embodiments. In certain embodiments one of $R^5$ or $R^6$ is methyl. In other embodiments each of $R^5$ or $R^6$ is methyl.

The substituents at $R^7$ of Formula (II) are not particularly limited in the foregoing embodiments. In certain embodiments $R^7$ is $C_6$-$C_{16}$ alkyl. In some other embodiments, $R^T$ is $C_6$-$C_9$ alkyl. In some of these embodiments, $R^7$ is substituted with —(C=)OR, —O(C=O)$R^b$, —C(=O)$R^b$, —O$R^b$, —S(O)$_x R^b$, —S—S$R^b$, —C(=O)S$R^b$, —SC(=O)$R^b$, —N$R^a R^b$, —N$R^a$C(=O)$R^b$, —C(=O)N$R^a R^b$, —N$R^a$C(=O)N$R^a R^b$, —OC(=O)N$R^a R^b$, —N$R^a$C(=O)O$R^b$, —N$R^a$S(O)$_x$N$R^a R^b$, —N$R^a$S(O)$_x R^b$ or —S(O)$_x$N$R^a R^b$, wherein: $R^a$ is H or $C_1$-$C_{12}$ alkyl; $R^b$ is $C_1$-$C_{15}$ alkyl; and x is 0, 1 or 2. For example, in some embodiments $R_7$ is substituted with —(C=O)O$R^b$ or —O(C=O)$R^b$.

In some of the foregoing embodiments of Formula (II), $R^b$ is branched $C_1$-$C_{16}$ alkyl. For example, in some embodiments $R^b$ has one of the following structures:

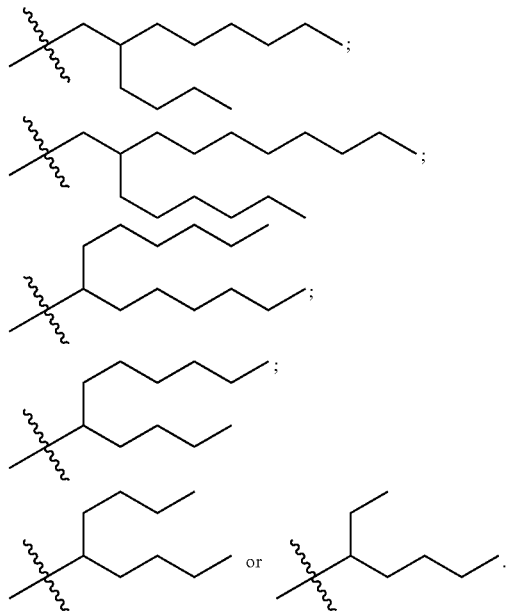

In certain other of the foregoing embodiments of Formula (II), one of $R^8$ or $R^9$ is methyl. In other embodiments, both $R^8$ and $R^9$ are methyl.

In some different embodiments of Formula (II), $R^8$ and $R^9$, together with the nitrogen atom to which they are attached, form a 5, 6 or 7-membered heterocyclic ring. In some embodiments of the foregoing, $R^8$ and $R^9$, together with the nitrogen atom to which they are attached, form a 5-membered heterocyclic ring, for example a pyrrolidinyl ring. In some different embodiments of the foregoing, $R^8$ and $R^9$, together with the nitrogen atom to which they are attached, form a 6-membered heterocyclic ring, for example a piperazinyl ring.

In certain embodiments of Embodiment 3, the first and second cationic lipids are each, independently selected from a lipid of Formula II.

In still other embodiments of the foregoing lipids of Formula (II), $G^3$ is $C_2$-$C_4$ alkylene, for example $C_3$ alkylene. In various different embodiments, the lipid compound has one of the structures set forth in Table 2 below TABLE 2
Representative Lipids of Formula (II)
| No. | Structure | pKa |
|---|---|---|
| II-1 | 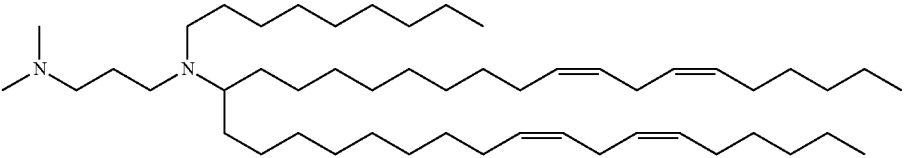 [SMILES: CCCCC/C=C\C/C=C\CCCCCCCCC(CCCCCCCC/C=C\C/C=C\CCCCC)N(CCCCCCCCC)CCCN(C)C] | 5.64 |
| II-2 | 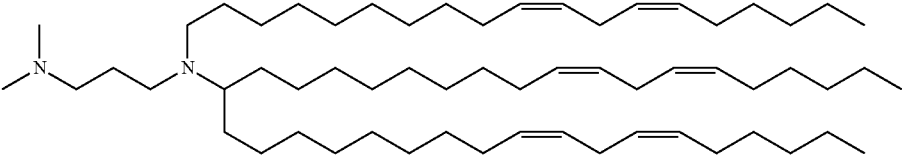 [SMILES: CCCCC/C=C\C/C=C\CCCCCCCCCN(CCCN(C)C)C(CCCCCCCC/C=C\C/C=C\CCCCC)CCCCCCCC/C=C\C/C=C\CCCCC] | — |
| II-3 | 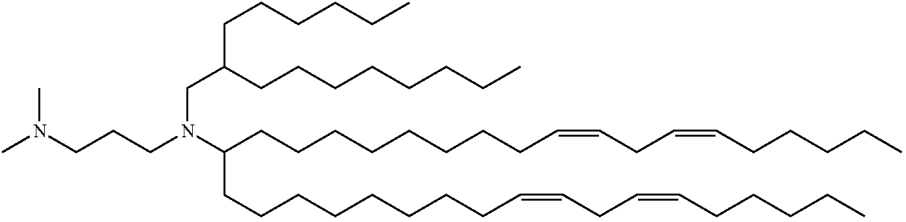 [SMILES: CCCCC/C=C\C/C=C\CCCCCCCCC(CCCCCCCC/C=C\C/C=C\CCCCC)N(CCCN(C)C)CC(CCCCCC)CCCCCCCC] | — |
| II-4 | 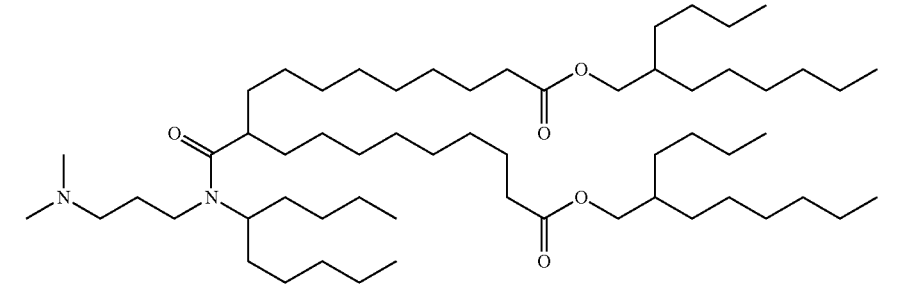 [SMILES: CCCCCCC(CCCC)COC(=O)CCCCCCCCC(CCCCCCCCC(=O)OCC(CCCC)CCCCCC)C(=O)N(CCCN(C)C)C(CCCC)CCCCC] | — |
| II-5 | 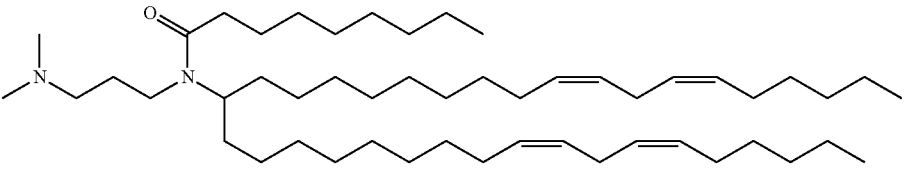 [SMILES: CCCCC/C=C\C/C=C\CCCCCCCCC(CCCCCCCC/C=C\C/C=C\CCCCC)N(CCCN(C)C)C(=O)CCCCCCCC] | 6.27 |
| II-6 | 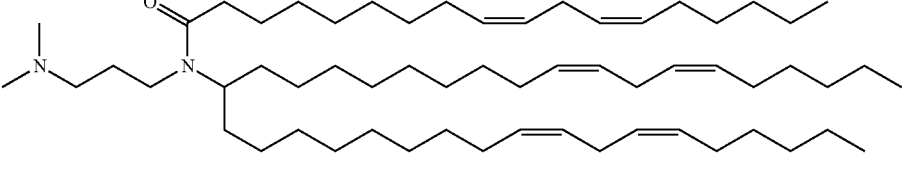 | 6.14 |
| II-7 | 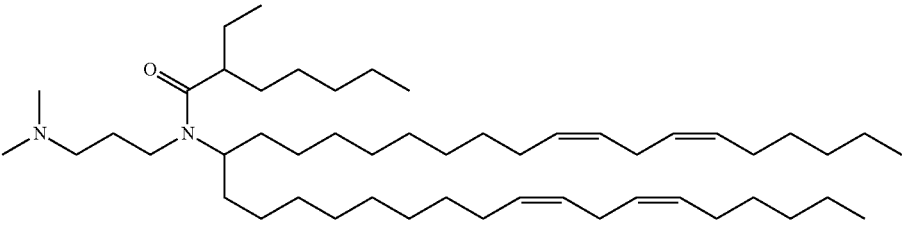 [SMILES: CCCCC/C=C\C/C=C\CCCCCCCCC(CCCCCCCC/C=C\C/C=C\CCCCC)N(CCCN(C)C)C(=O)C(CC)CCCCC] | 5.93 |

TABLE 2-continued

Representative Lipids of Formula (II)

| No. | Structure | pKa |
|---|---|---|
| II-8 | 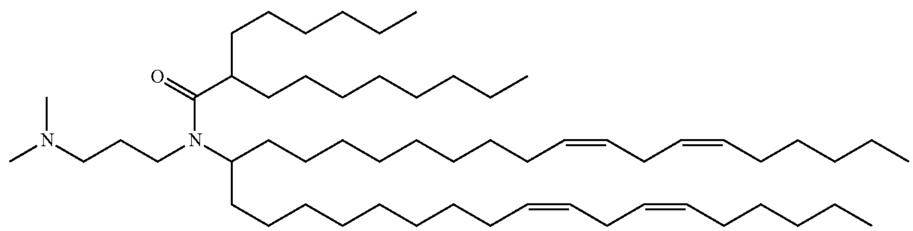 [SMILES: CCCCC/C=C\C/C=C\CCCCCCCCC(CCCCCCCC/C=C\C/C=C\CCCCC)N(CCCN(C)C)C(=O)C(CCCCCC)CCCCCCCC] | 5.35 |
| II-9 | 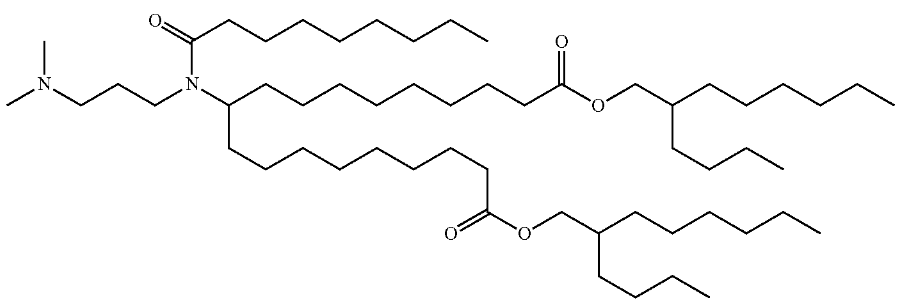 [SMILES: CCCCCCCCC(=O)N(CCCN(C)C)C(CCCCCCCCC(=O)OCC(CCCC)CCCCCC)CCCCCCCCC(=O)OCC(CCCC)CCCCCC] | 6.27 |
| II-10 | 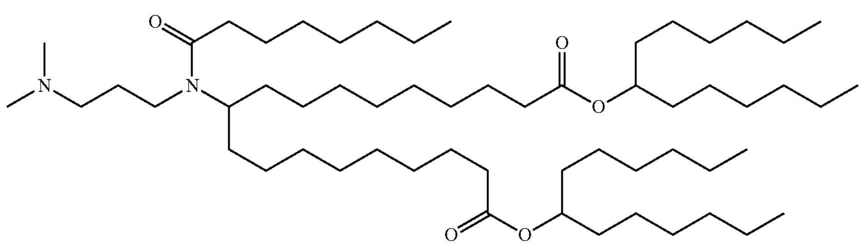 [SMILES: CCCCCCCC(=O)N(CCCN(C)C)C(CCCCCCCCC(=O)OC(CCCCCC)CCCCCC)CCCCCCCCC(=O)OC(CCCCCC)CCCCCC] | 6.16 |
| II-11 | 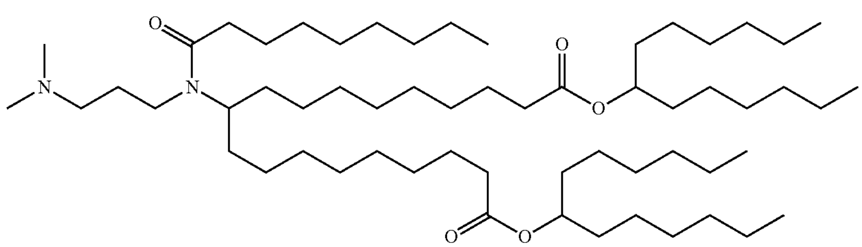 [SMILES: CCCCCCCCC(=O)N(CCCN(C)C)C(CCCCCCCCC(=O)OC(CCCCCC)CCCCCC)CCCCCCCCC(=O)OC(CCCCCC)CCCCCC] | 6.13 |
| II-12 | 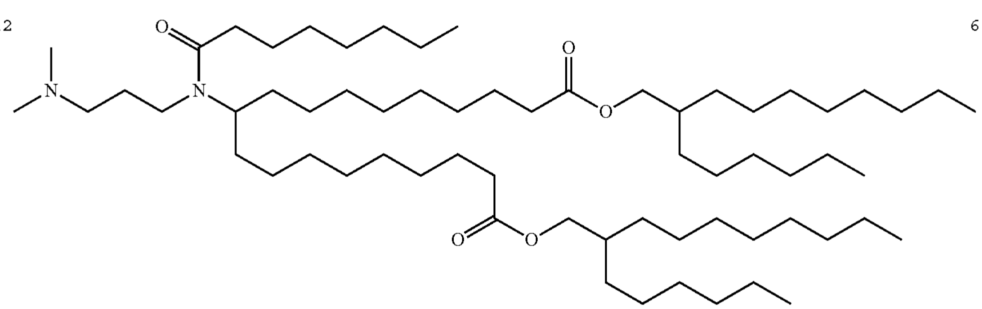 | 6.21 |

TABLE 2-continued

Representative Lipids of Formula (II)

| No. | Structure | pKa |
|---|---|---|
| II-13 | 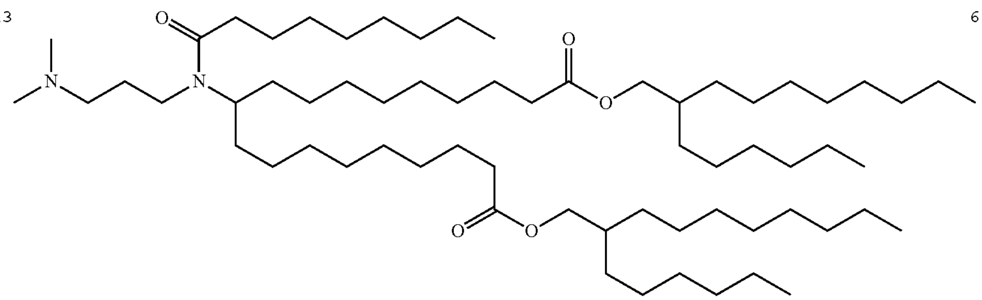 | 6.22 |
| II-14 | 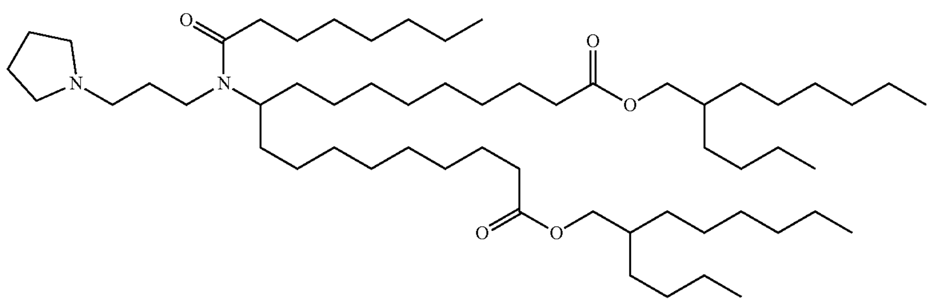 [SMILES: CCCCCCCC(=O)N(CCCN1CCCC1)C(CCCCCCCCC(=O)OCC(CCCC)CCCCCC)CCCCCCCCC(=O)OCC(CCCC)CCCCCC] | 6.33 |
| II-15 | 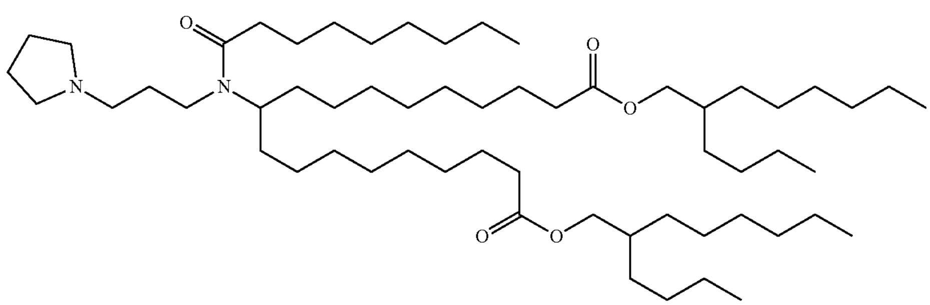 [SMILES: CCCCCCCCC(=O)N(CCCN1CCCC1)C(CCCCCCCCC(=O)OCC(CCCC)CCCCCC)CCCCCCCCC(=O)OCC(CCCC)CCCCCC] | 6.32 |
| II-16 | 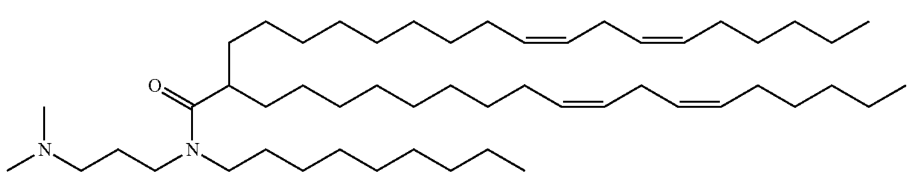 [SMILES: CCCCC/C=C\C/C=C\CCCCCCCCC(CCCCCCCC/C=C\C/C=C\CCCCC)C(=O)N(CCCCCCCCC)CCCN(C)C] | 6.37 |
| II-17 | 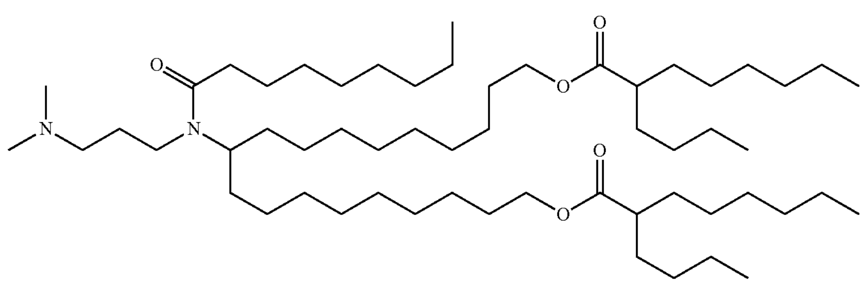 [SMILES: CCCCCCCCC(=O)N(CCCN(C)C)C(CCCCCCCCCOC(=O)C(CCCC)CCCCCC)CCCCCCCCCOC(=O)C(CCCC)CCCCCC] | 6.27 |

TABLE 2-continued

Representative Lipids of Formula (II)

| No. | Structure | pKa |
|---|---|---|
| II-18 | 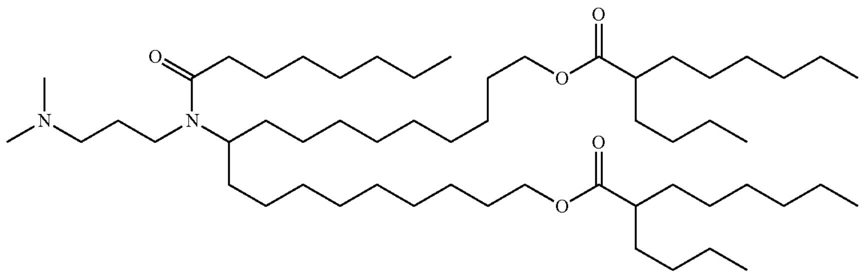 [SMILES: CCCCCCCC(=O)N(CCCN(C)C)C(CCCCCCCCCOC(=O)C(CCCC)CCCCCC)CCCCCCCCCOC(=O)C(CCCC)CCCCCC] | — |
| II-19 | 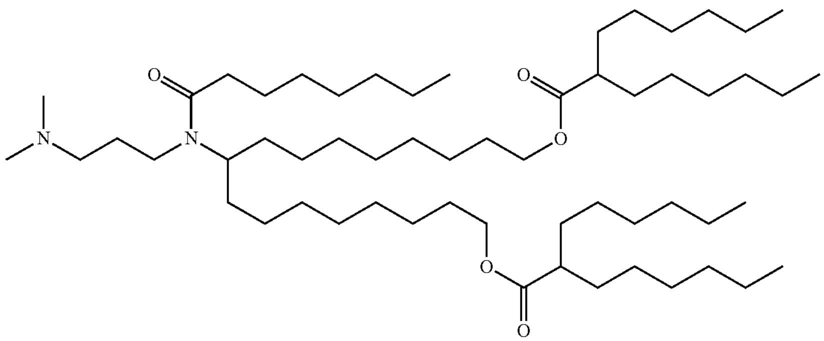 [SMILES: CCCCCCCC(=O)N(CCCN(C)C)C(CCCCCCCCOC(=O)C(CCCCCC)CCCCCC)CCCCCCCCOC(=O)C(CCCCCC)CCCCCC] | — |
| II-20 | 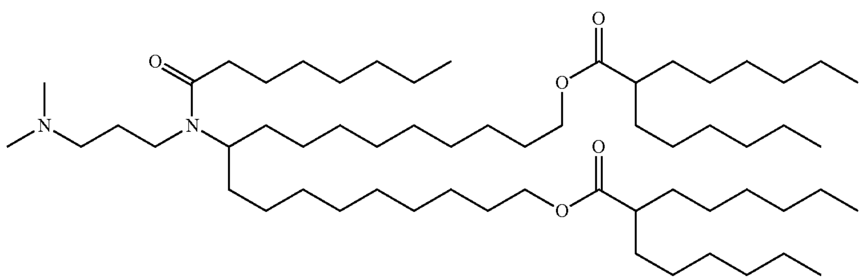 [SMILES: CCCCCCCC(=O)N(CCCN(C)C)C(CCCCCCCCCOC(=O)C(CCCCCC)CCCCCC)CCCCCCCCCOC(=O)C(CCCCCC)CCCCCC] | — |
| II-21 | 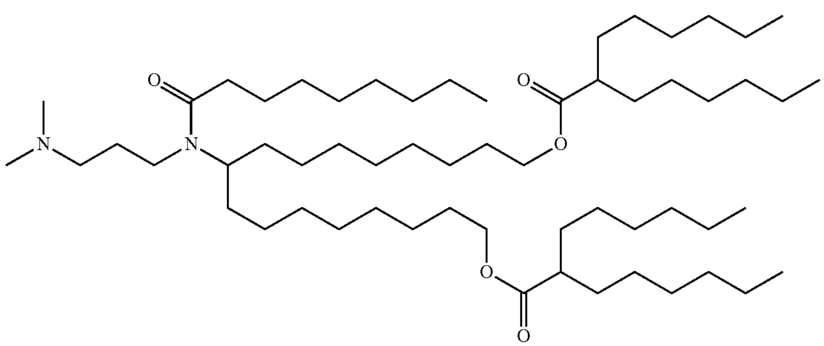 [SMILES: CCCCCCCCC(=O)N(CCCN(C)C)C(CCCCCCCCOC(=O)C(CCCCCC)CCCCCC)CCCCCCCCOC(=O)C(CCCCCC)CCCCCC] | — |
| II-22 | 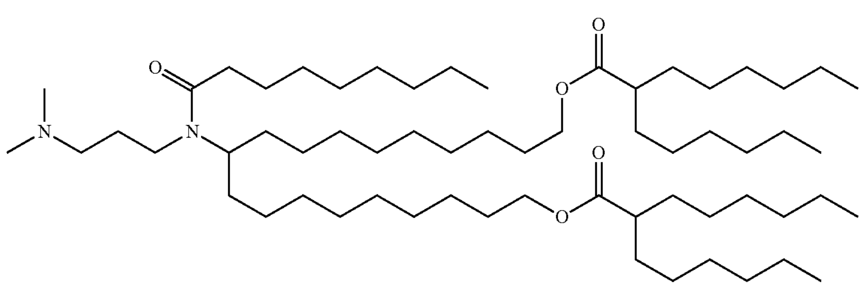 [SMILES: CCCCCCCCC(=O)N(CCCN(C)C)C(CCCCCCCCCOC(=O)C(CCCCCC)CCCCCC)CCCCCCCCCOC(=O)C(CCCCCC)CCCCCC] | — |

TABLE 2-continued

Representative Lipids of Formula (II)

| No. | Structure | pKa |
|---|---|---|
| II-23 | 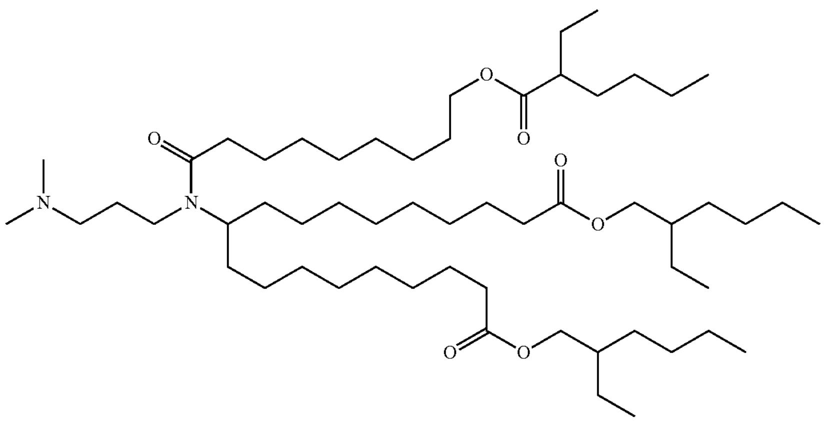 [SMILES: CCCCC(CC)COC(=O)CCCCCCCCC(CCCCCCCCC(=O)OCC(CC)CCCC)N(CCCN(C)C)C(=O)CCCCCCCCOC(=O)C(CC)CCCC] | — |
| II-24 | 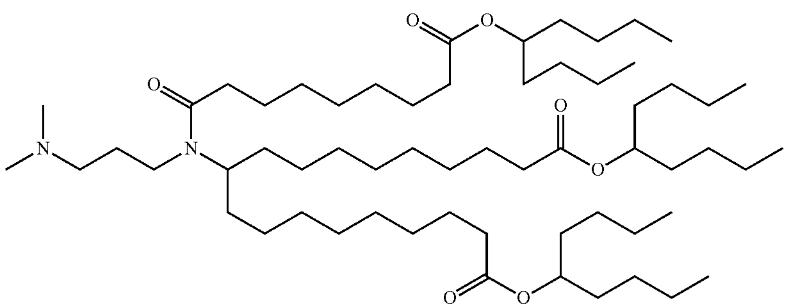 [SMILES: CCCCC(CCCC)OC(=O)CCCCCCCCC(CCCCCCCCC(=O)OC(CCCC)CCCC)N(CCCN(C)C)C(=O)CCCCCCCC(=O)OC(CCCC)CCCC] | 6.14 |
| II-25 | 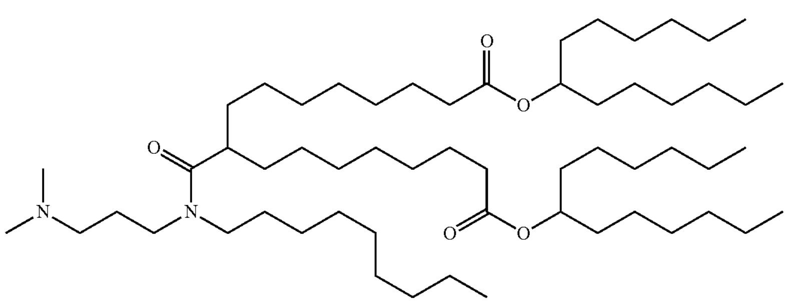 [SMILES: CCCCCCCCCN(CCCN(C)C)C(=O)C(CCCCCCCC(=O)OC(CCCCCC)CCCCCC)CCCCCCCC(=O)OC(CCCCCC)CCCCCC] | — |
| II-26 | 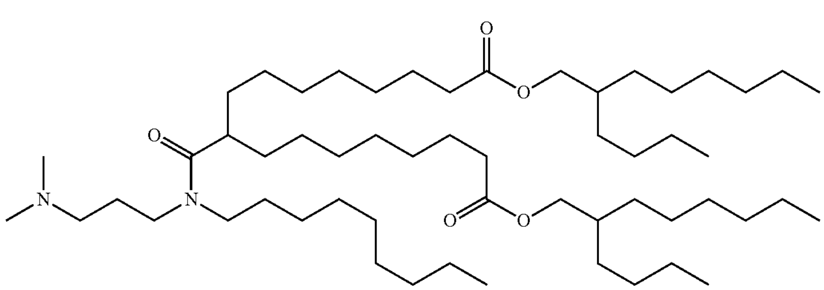 [SMILES: CCCCCCCCCN(CCCN(C)C)C(=O)C(CCCCCCCC(=O)OCC(CCCC)CCCCCC)CCCCCCCC(=O)OCC(CCCC)CCCCCC] | — |

TABLE 2-continued
Representative Lipids of Formula (II)
| No. | Structure | pKa |
|---|---|---|
| II-27 | 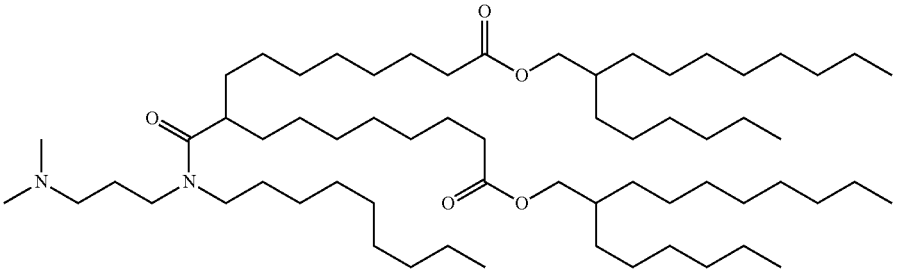 [SMILES: CCCCCCCCCN(CCCN(C)C)C(=O)C(CCCCCCCC(=O)OCC(CCCCCC)CCCCCCCC)CCCCCCCC(=O)OCC(CCCCCC)CCCCCCCC] | — |
| II-28 | 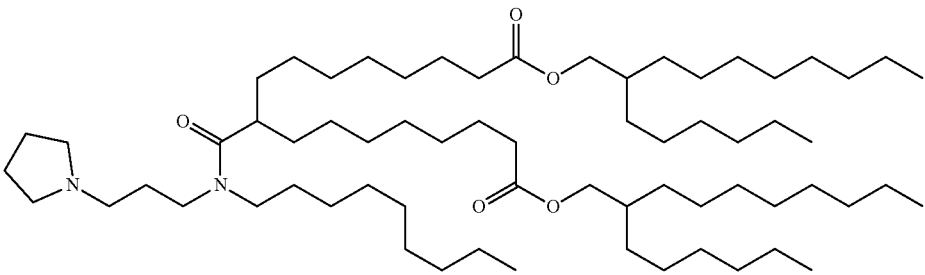 [SMILES: CCCCCCCCCN(CCCN1CCCC1)C(=O)C(CCCCCCCC(=O)OCC(CCCCCC)CCCCCCCC)CCCCCCCC(=O)OCC(CCCCCC)CCCCCCCC] | — |
| II-29 | 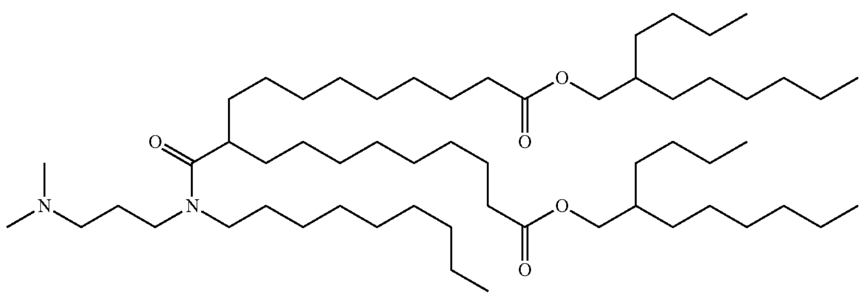 [SMILES: CCCCCCCCCN(CCCN(C)C)C(=O)C(CCCCCCCCC(=O)OCC(CCCC)CCCCCC)CCCCCCCCC(=O)OCC(CCCC)CCCCCC] | — |
| II-30 | 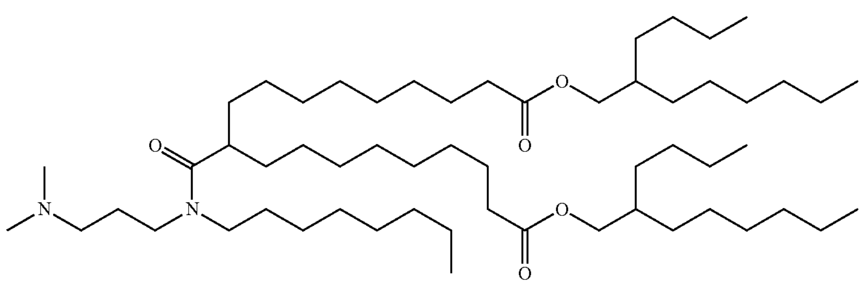 [SMILES: CCCCCCCCN(CCCN(C)C)C(=O)C(CCCCCCCCC(=O)OCC(CCCC)CCCCCC)CCCCCCCCC(=O)OCC(CCCC)CCCCCC] | — |
| II-31 | 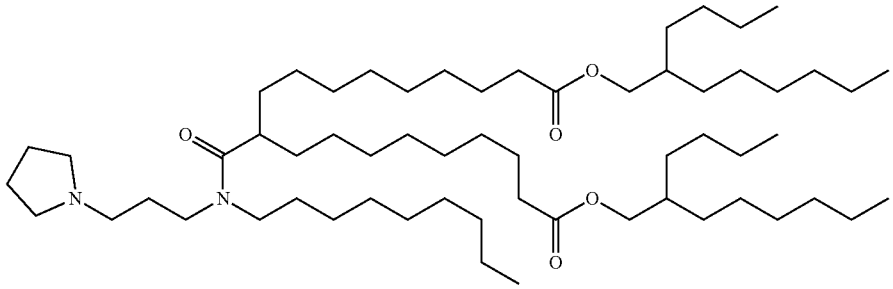 [SMILES: CCCCCCCCCN(CCCN1CCCC1)C(=O)C(CCCCCCCCC(=O)OCC(CCCC)CCCCCC)CCCCCCCCC(=O)OCC(CCCC)CCCCCC] | — |

TABLE 2-continued

Representative Lipids of Formula (II)

| No. | Structure | pKa |
|---|---|---|
| II-32 | 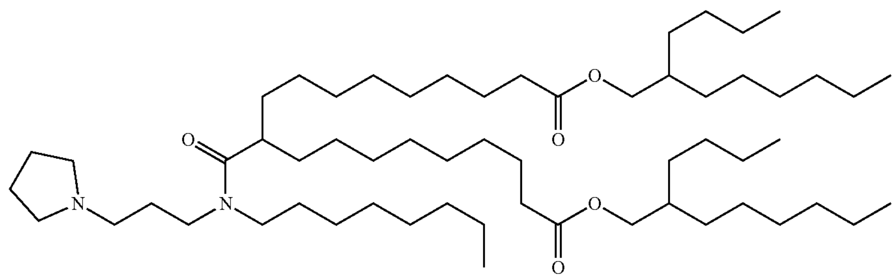 [SMILES: CCCCCCCCN(CCCN1CCCC1)C(=O)C(CCCCCCCCC(=O)OCC(CCCC)CCCCCC)CCCCCCCCC(=O)OCC(CCCC)CCCCCC] | — |
| II-33 | 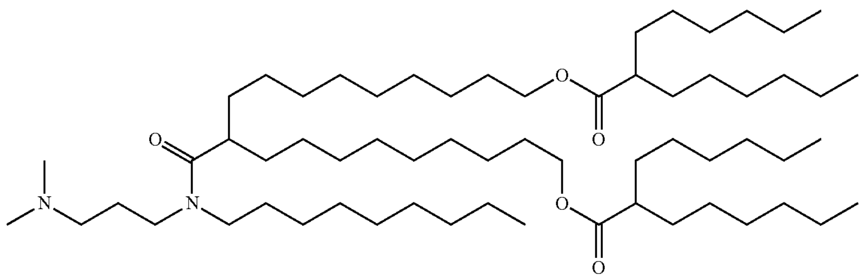 [SMILES: CCCCCCCCCN(CCCN(C)C)C(=O)C(CCCCCCCCCOC(=O)C(CCCCCC)CCCCCC)CCCCCCCCCOC(=O)C(CCCCCC)CCCCCC] | — |
| II-34 | 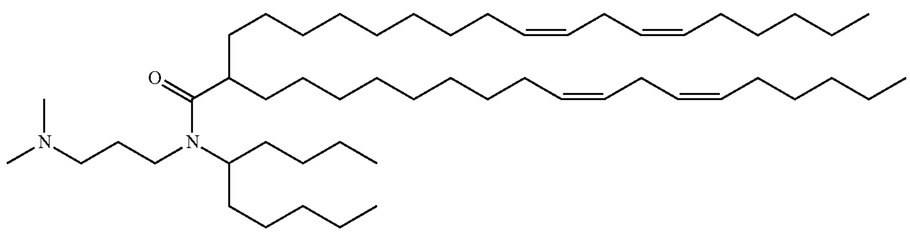 [SMILES: CCCCC/C=C\C/C=C\CCCCCCCCC(CCCCCCCC/C=C\C/C=C\CCCCC)C(=O)N(CCCN(C)C)C(CCCC)CCCCC] | — |
| II-35 | 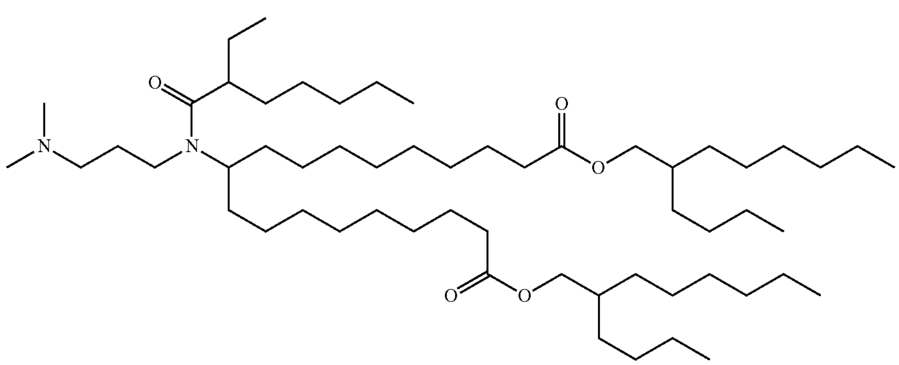 [SMILES: CCCCCCC(CCCC)COC(=O)CCCCCCCCC(CCCCCCCCC(=O)OCC(CCCC)CCCCCC)N(CCCN(C)C)C(=O)C(CC)CCCCC] | 5.97 |
| II-36 | 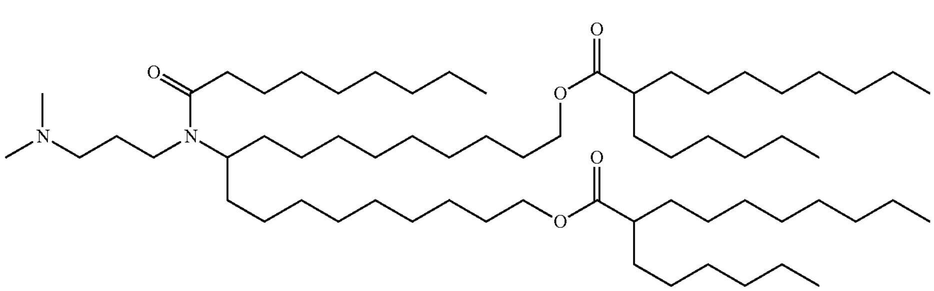 [SMILES: CCCCCCCCC(=O)N(CCCN(C)C)C(CCCCCCCCCOC(=O)C(CCCCCC)CCCCCCCC)CCCCCCCCCOC(=O)C(CCCCCC)CCCCCCCC] | 6.13 |

TABLE 2-continued

Representative Lipids of Formula (II)

| No. | Structure | pKa |
|---|---|---|
| II-37 | 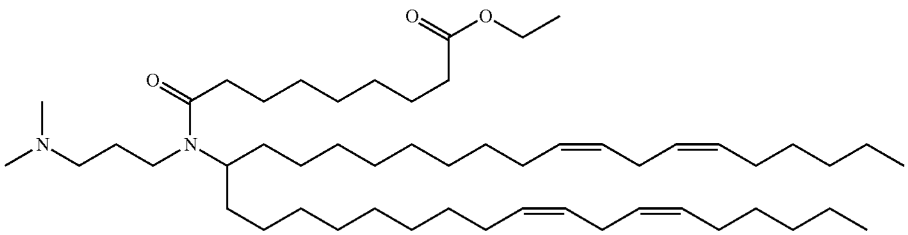 [SMILES: CCCCC/C=C\C/C=C\CCCCCCCCC(CCCCCCCC/C=C\C/C=C\CCCCC)N(CCCN(C)C)C(=O)CCCCCCCC(=O)OCC] | 5.61 |
| II-38 | 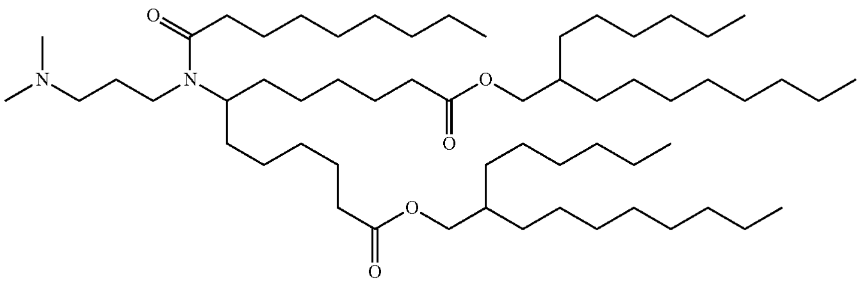 [SMILES: CCCCCCCCC(=O)N(CCCN(C)C)C(CCCCCC(=O)OCC(CCCCCC)CCCCCCCC)CCCCCC(=O)OCC(CCCCCC)CCCCCCCC] | 6.45 |
| II-39 | 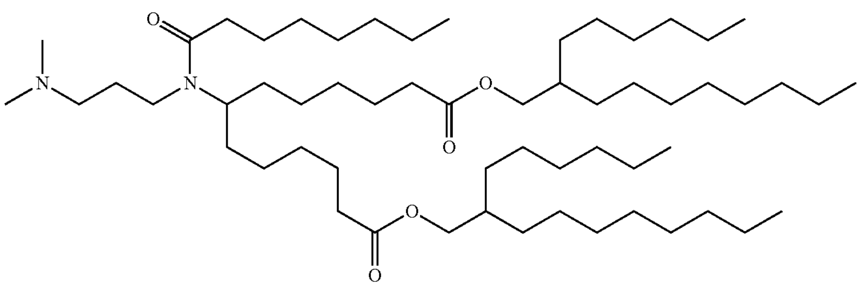 [SMILES: CCCCCCCCC(CCCCCC)COC(=O)CCCCCC(CCCCCC(=O)OCC(CCCCCC)CCCCCCCC)N(CCCN(C)C)C(=O)CCCCCCC] | 6.45 |
| II-40 | 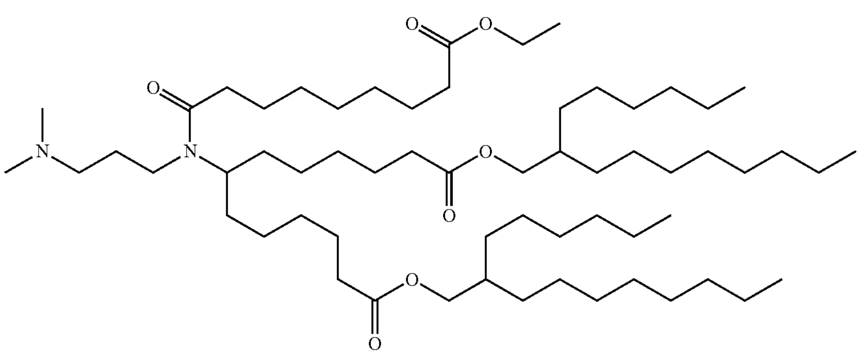 [SMILES: CCCCCCCCC(CCCCCC)COC(=O)CCCCCC(CCCCCC(=O)OCC(CCCCCC)CCCCCCCC)N(CCCN(C)C)C(=O)CCCCCCCC(=O)OCC] | 6.57 |
| II-41 | 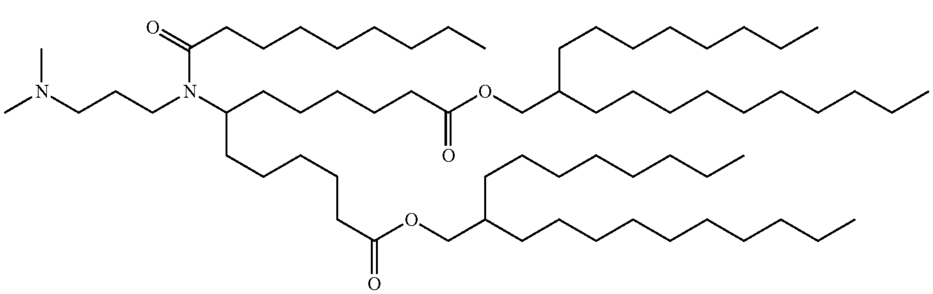 [SMILES: CCCCCCCCCCC(CCCCCCCC)COC(=O)CCCCCC(CCCCCC(=O)OCC(CCCCCCCC)CCCCCCCCCC)N(CCCN(C)C)C(=O)CCCCCCCC] | — |

TABLE 2-continued

Representative Lipids of Formula (II)

| No. | Structure | pKa |
|---|---|---|
| II-42 | 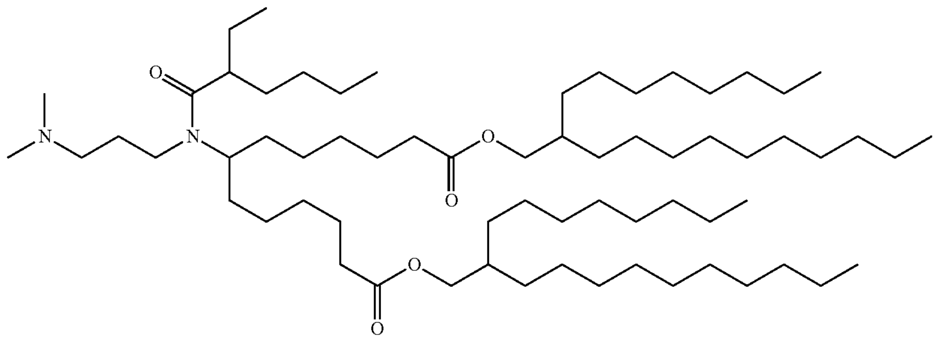 [SMILES: CCCCCCCCCCC(CCCCCCCC)COC(=O)CCCCCC(CCCCCC(=O)OCC(CCCCCCCC)CCCCCCCCCC)N(CCCN(C)C)C(=O)C(CC)CCCC] | — |
| II-43 | 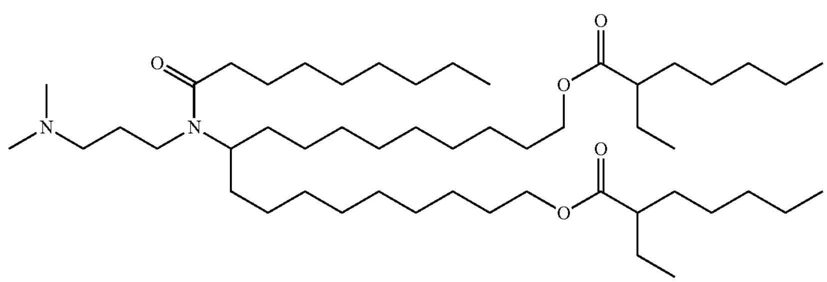 [SMILES: CCCCCCCCC(=O)N(CCCN(C)C)C(CCCCCCCCCOC(=O)C(CC)CCCCC)CCCCCCCCCOC(=O)C(CC)CCCCC] | — |
| II-44 | 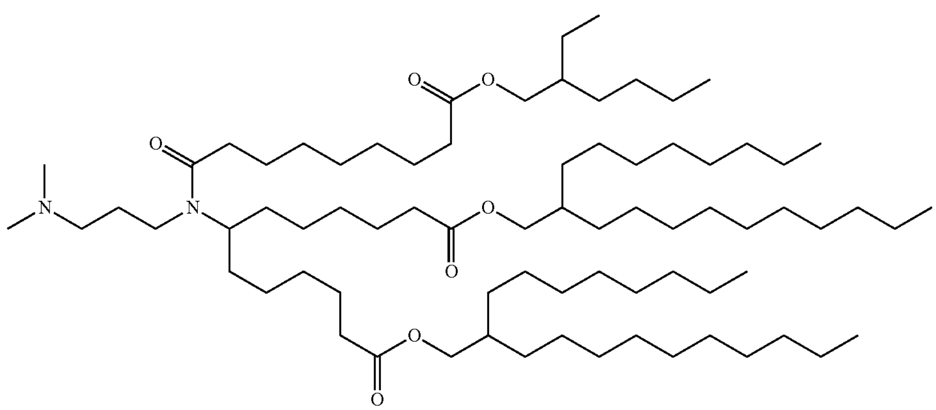 [SMILES: CCCCCCCCCCC(CCCCCCCC)COC(=O)CCCCCC(CCCCCC(=O)OCC(CCCCCCCC)CCCCCCCCCC)N(CCCN(C)C)C(=O)CCCCCCCC(=O)OCC(CC)CCCC] | — |
| II-45 | 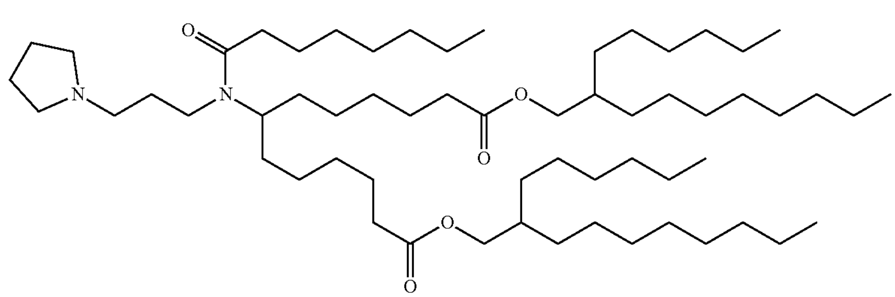 [SMILES: CCCCCCCCC(CCCCCC)COC(=O)CCCCCC(CCCCCC(=O)OCC(CCCCCC)CCCCCCCC)N(CCCN1CCCC1)C(=O)CCCCCCC] | — |

TABLE 2-continued

Representative Lipids of Formula (II)

| No. | Structure | pKa |
|---|---|---|
| II-46 | 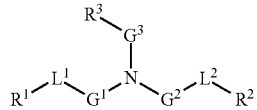 | — |

In some other embodiments, the cationic lipid of Embodiments 1, 2, 3, 4 or 5 has a structure of Formula III:

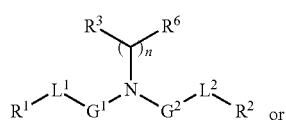
III or a pharmaceutically acceptable salt, prodrug or stereoisomer thereof, wherein:

one of $L^1$ or $L^2$ is —O(C=O)—, —(C=O)O—, —C(=O)—, —O—, —S(O)$_x$—, —S—S—, —C(=O)S—, SC(=O)—, —NR$^a$C(=O)—, —C(=O)NR$^a$—, NR$^a$C(=O)NR$^a$—, —OC(=O)NR$^a$— or —NR$^a$C(=O)O—, and the other of $L^1$ or $L^2$ is —O(C=O)—, —(C=O)O—, —C(=O)—, —O—, —S(O)$_x$—, —S—S—, —C(=O)S—, SC(=O)—, —NR$^a$C(=O)—, —C(=O)NR$^a$—, NR$^a$C(=O)NR$^a$—, —OC(=O)NR$^a$— or —NR$^a$C(=O)O— or a direct bond;

$G^1$ and $G^2$ are each independently unsubstituted $C_1$-$C_{12}$ alkylene or $C_1$-$C_{12}$ alkenylene;

$G^3$ is $C_1$-$C_{24}$ alkylene, $C_1$-$C_{24}$ alkenylene, $C_3$-$C_8$ cycloalkylene, $C_3$-$C_8$ cycloalkenylene;

$R^a$ is H or $C_1$-$C_{12}$ alkyl;

$R^1$ and $R^2$ are each independently $C_6$-$C_{24}$ alkyl or $C_6$-$C_{24}$ alkenyl;

$R^3$ is H, $OR^5$, CN, —C(=O)OR$^4$, —OC(=O)R$^4$ or —NR$^5$C(=O)R$^4$;

$R^4$ is $C_1$-$C_{12}$ alkyl;

$R^5$ is H or $C_1$-$C_6$ alkyl; and x is 0, 1 or 2.

In some of the foregoing embodiments of Formula (III), the lipid has one of the following Formulae (IIIA) or (IIIB):

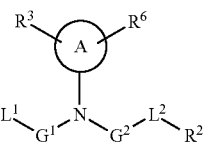
(IIIA)

-continued (IIIB)

wherein:

A is a 3 to 8-membered cycloalkyl or cycloalkylene ring;

$R^6$ is, at each occurrence, independently H, OH or $C_1$-$C_{24}$ alkyl;

n is an integer ranging from 1 to 15.

In some of the foregoing embodiments of Formula (III), the lipid has Formula (IIIA), and in other embodiments, the lipid has Formula (IIIB).

In other embodiments of Formula (III), the lipid has one of the following Formulae (IIIC) or (IIID):

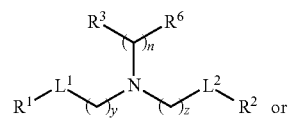
(IIIC)

or (IIID)

wherein y and z are each independently integers ranging from 1 to 12.

In any of the foregoing embodiments of Formula (III), one of $L^1$ or $L^2$ is —O(C=O)—. For example, in some embodiments each of $L^1$ and $L^2$ are —O(C=O)—. In some different embodiments of any of the foregoing, $L^1$ and $L^2$ are each independently —(C=O)O— or —O(C=O)—. For example, in some embodiments each of $L^1$ and $L^2$ is —(C=O)O—.

In some different embodiments of Formula (III), the lipid has one of the following Formulae (IIIE) or (IIIF):

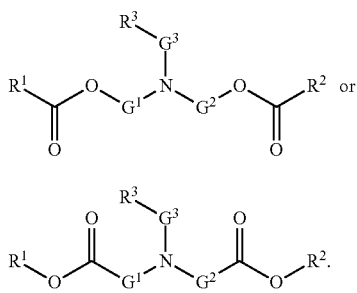

(IIIE)

(IIIF)

In some of the foregoing embodiments of Formula (III), the lipid has one of the following Formulae (IIIG), (IIIH), (IIII), or (IIIJ):

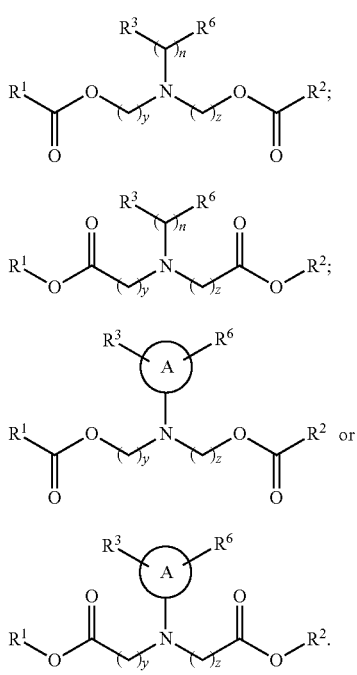

(IIIG)

(IIIH)

(IIII)

(IIIJ)

In some of the foregoing embodiments of Formula (III), n is an integer ranging from 2 to 12, for example from 2 to 8 or from 2 to 4. For example, in some embodiments, n is 3, 4, 5 or 6. In some embodiments, n is 3. In some embodiments, n is 4. In some embodiments, n is 5. In some embodiments, n is 6.

In some other of the foregoing embodiments of Formula (III), y and z are each independently an integer ranging from 2 to 10. For example, in some embodiments, y and z are each independently an integer ranging from 4 to 9 or from 4 to 6.

In some of the foregoing embodiments of Formula (III), $R^6$ is H. In other of the foregoing embodiments, $R^6$ is $C_1$-$C_{24}$ alkyl. In other embodiments, $R^6$ is OH.

In some embodiments of Formula (III), $G^3$ is unsubstituted. In other embodiments, G3 is substituted. In various different embodiments, $G^3$ is linear $C_1$-$C_{24}$ alkylene or linear $C_1$-$C_{24}$ alkenylene.

In some other foregoing embodiments of Formula (III), $R^1$ or R, or both, is $C_6$-$C_{24}$ alkenyl. For example, in some embodiments, $R^1$ and $R^2$ each, independently have the following structure:

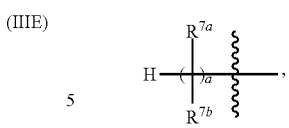

wherein:

$R^{7a}$ and $R^{7b}$ are, at each occurrence, independently H or $C_1$-$C_{12}$ alkyl; and a is an integer from 2 to 12, wherein $R^{7a}$, $R^{7b}$ and a are each selected such that $R^1$ and $R^2$ each independently comprise from 6 to 20 carbon atoms. For example, in some embodiments a is an integer ranging from 5 to 9 or from 8 to 12.

In some of the foregoing embodiments of Formula (III), at least one occurrence of $R^{7a}$ is H. For example, in some embodiments, $R^{7a}$ is H at each occurrence. In other different embodiments of the foregoing, at least one occurrence of $R^{7b}$ is $C_1$-$C_8$ alkyl. For example, in some embodiments, $C_1$-$C_8$ alkyl is methyl, ethyl, n-propyl, iso-propyl, n-butyl, iso-butyl, tert-butyl, n-hexyl or n-octyl.

In different embodiments of Formula (III), $R^1$ or $R^2$, or both, has one of the following structures:

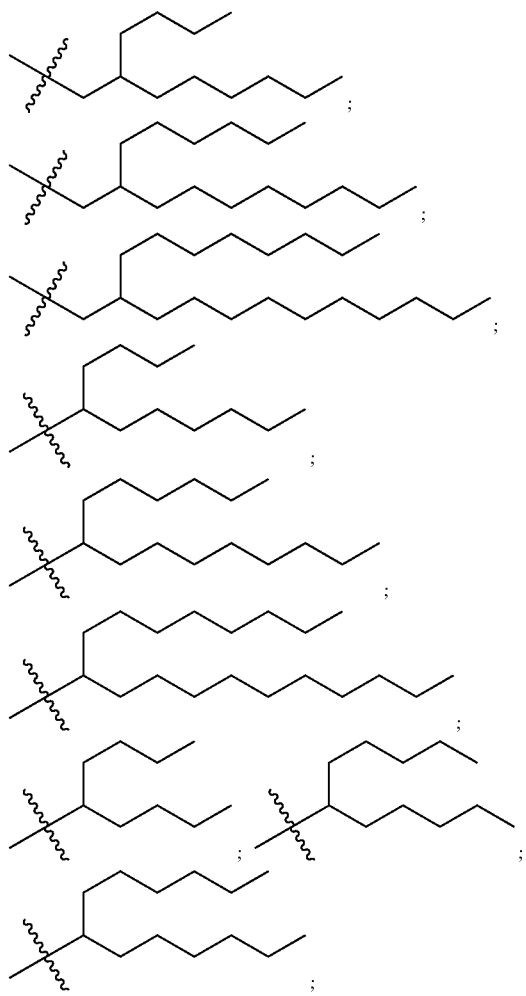

-continued

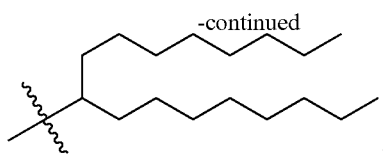

In some of the foregoing embodiments of Formula (III), $R^3$ is OH, CN, —C(=O)OR$^4$, —OC(=O)R$_4$ or —NHC(=O)R$^4$. In some embodiments, $R^4$ is methyl or ethyl.

In some specific embodiments of Embodiment 3, the first and second cationic lipids are each, independently selected from a lipid of Formula III.

In various different embodiments, a cationic lipid of any one of the disclosed embodiments (e.g., the cationic lipid, the first cationic lipid, the second cationic lipid) of Formula (III) has one of the structures set forth in Table 3 below.

TABLE 3

Representative Compounds of Formula (III)

| No. | Structure | pKa |
|---|---|---|
| III-1 | 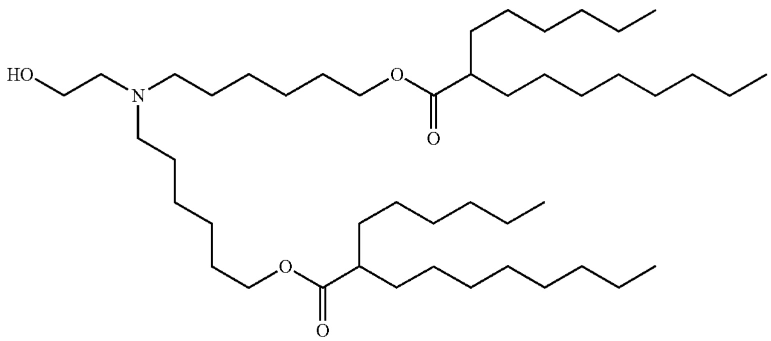 [SMILES: CCCCCCCCC(CCCCCC)C(=O)OCCCCCCN(CCO)CCCCCCOC(=O)C(CCCCCC)CCCCCCCC] | 5.89 |
| III-2 | 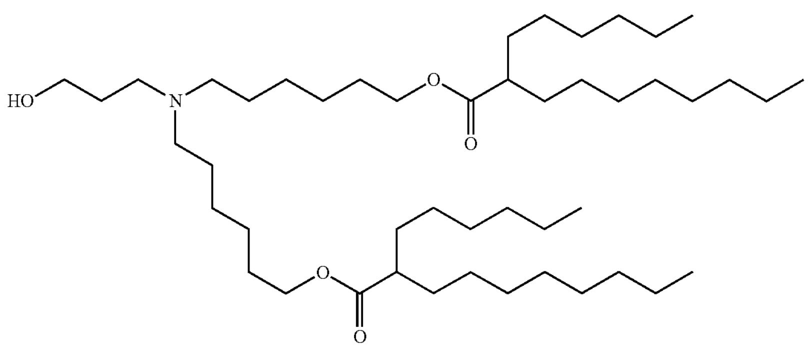 [SMILES: CCCCCCCCC(CCCCCC)C(=O)OCCCCCCN(CCCO)CCCCCCOC(=O)C(CCCCCC)CCCCCCCC] | 6.05 |
| III-3 | 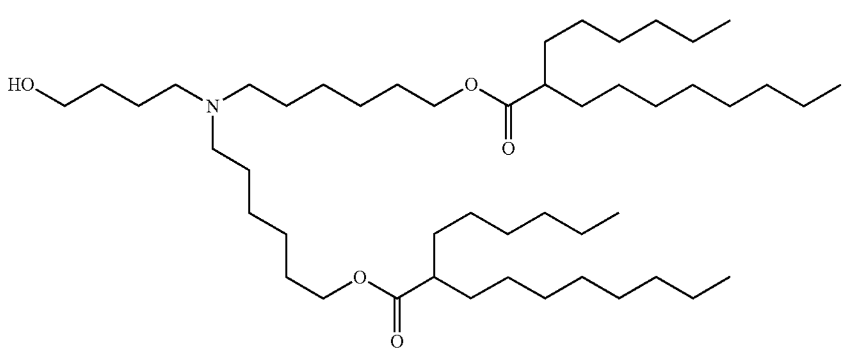 [SMILES: CCCCCCCCC(CCCCCC)C(=O)OCCCCCCN(CCCCO)CCCCCCOC(=O)C(CCCCCC)CCCCCCCC] | 6.09 |

TABLE 3-continued
| Representative Compounds of Formula (III) | | |
|---|---|---|
| No. | Structure | pKa |
| III-4 | 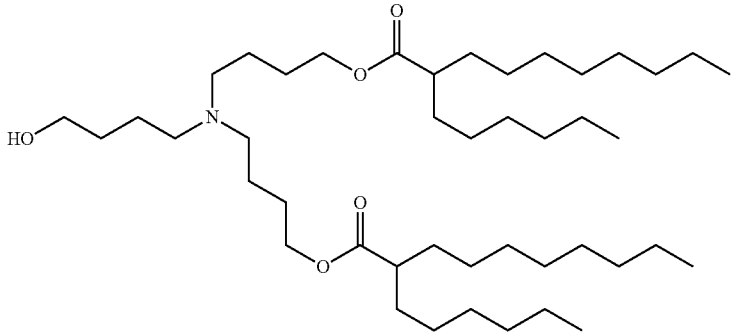 [SMILES: CCCCCCCCC(CCCCCC)C(=O)OCCCCN(CCCCO)CCCCOC(=O)C(CCCCCC)CCCCCCCC] | 5.60 |
| III-5 | 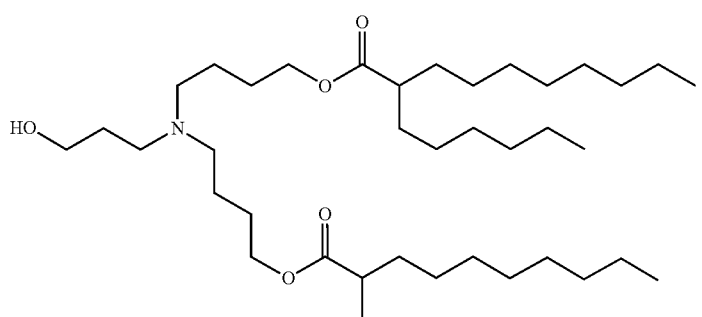 | 5.59 |
| III-6 | 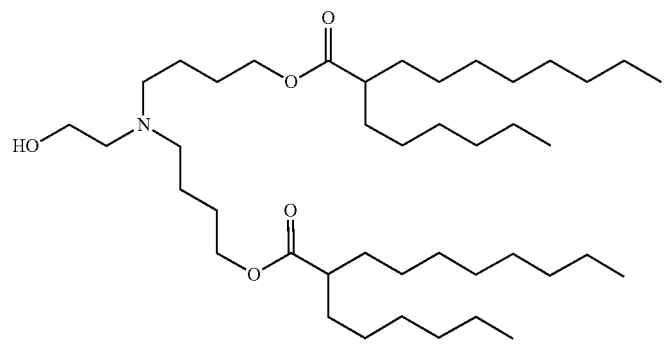 [SMILES: CCCCCCCCC(CCCCCC)C(=O)OCCCCN(CCO)CCCCOC(=O)C(CCCCCC)CCCCCCCC] | 5.42 |
| III-7 | 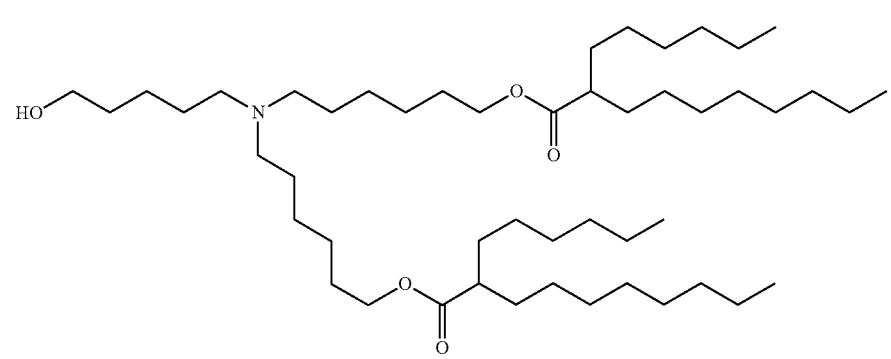 [SMILES: CCCCCCCCC(CCCCCC)C(=O)OCCCCCCN(CCCCCO)CCCCCCOC(=O)C(CCCCCC)CCCCCCCC] | 6.11 |

TABLE 3-continued

Representative Compounds of Formula (III)

| No. | Structure | pKa |
|---|---|---|
| III-8 | 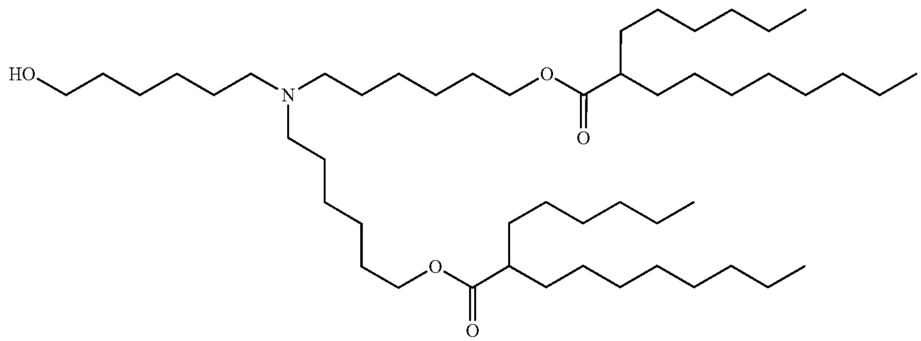 [SMILES: CCCCCCCCC(CCCCCC)C(=O)OCCCCCCN(CCCCCCO)CCCCCCOC(=O)C(CCCCCC)CCCCCCCC] | 5.84 |
| III-9 | 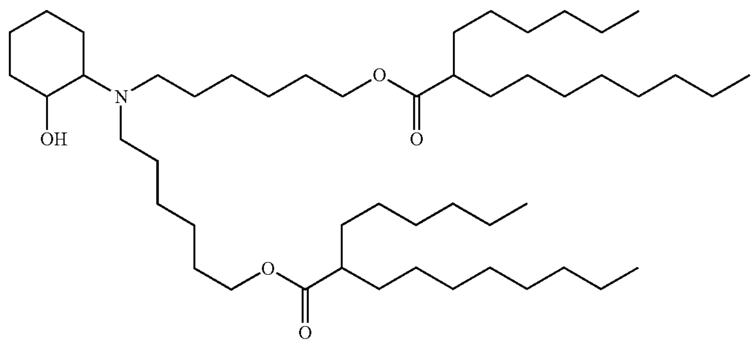 [SMILES: CCCCCCCCC(CCCCCC)C(=O)OCCCCCCN(CCCCCCOC(=O)C(CCCCCC)CCCCCCCC)C1CCCCC1O] | — |
| III-10 | 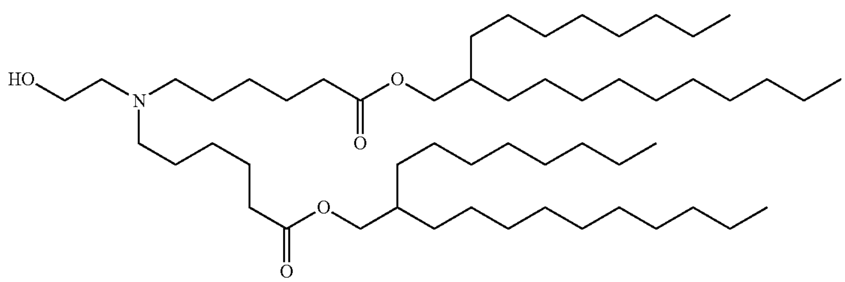 [SMILES: CCCCCCCCCCC(CCCCCCCC)COC(=O)CCCCCN(CCO)CCCCCC(=O)OCC(CCCCCCCC)CCCCCCCCCC] | — |
| III-11 | 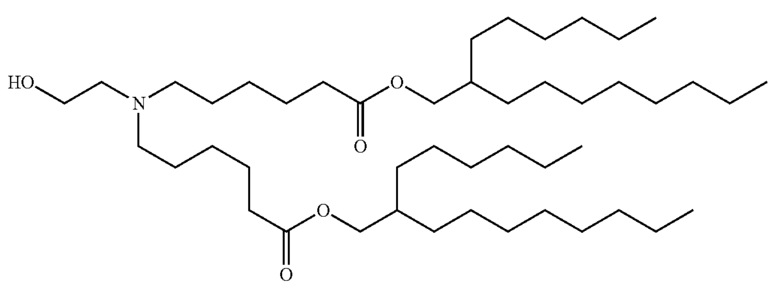 [SMILES: CCCCCCCCC(CCCCCC)COC(=O)CCCCCN(CCO)CCCCCC(=O)OCC(CCCCCC)CCCCCCCC] | — |
| III-12 | 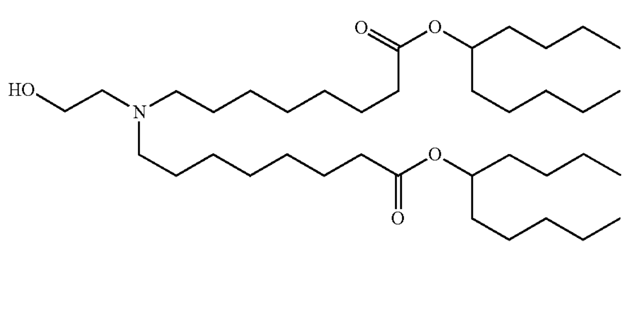 [SMILES: CCCCCC(CCCC)OC(=O)CCCCCCCN(CCO)CCCCCCCC(=O)OC(CCCC)CCCCC] | — |

TABLE 3-continued

Representative Compounds of Formula (III)

| No. | Structure | pKa |
|---|---|---|
| III-13 | 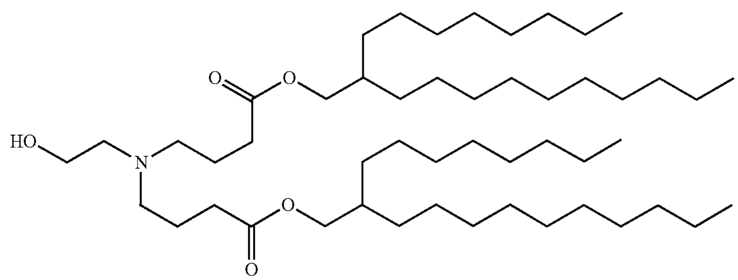 [SMILES: CCCCCCCCCCC(CCCCCCCC)COC(=O)CCCN(CCO)CCCC(=O)OCC(CCCCCCCC)CCCCCCCCCC] | — |
| III-14 | 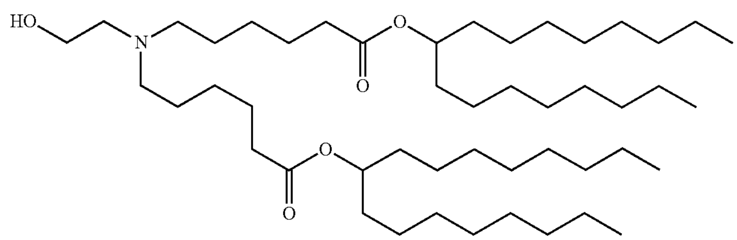 [SMILES: CCCCCCCCC(CCCCCCCC)OC(=O)CCCCCN(CCO)CCCCCC(=O)OC(CCCCCCCC)CCCCCCCC] | — |
| III-15 | 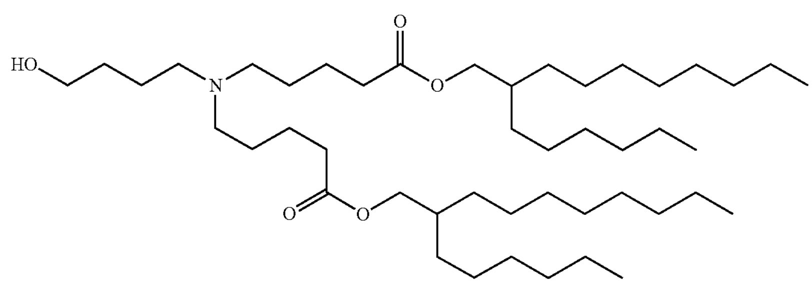 [SMILES: CCCCCCCCC(CCCCCC)COC(=O)CCCCN(CCCCO)CCCCC(=O)OCC(CCCCCC)CCCCCCCC] | 6.14 |
| III-16 | 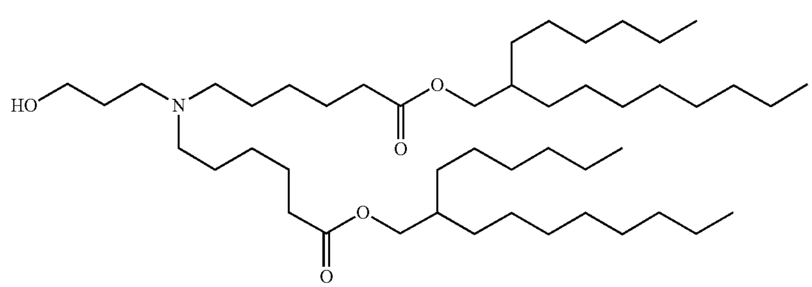 [SMILES: CCCCCCCCC(CCCCCC)COC(=O)CCCCCN(CCCO)CCCCCC(=O)OCC(CCCCCC)CCCCCCCC] | 6.31 |
| III-17 | 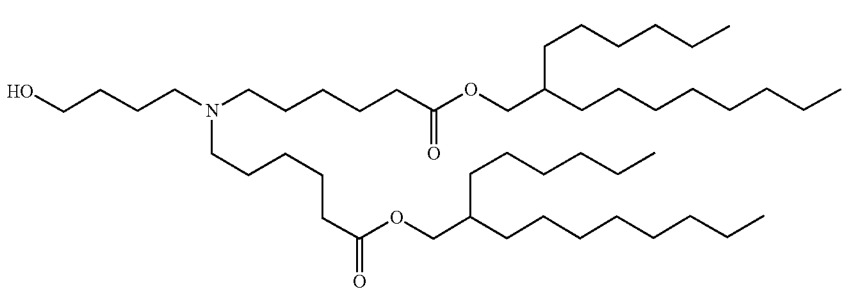 [SMILES: CCCCCCCCC(CCCCCC)COC(=O)CCCCCN(CCCCO)CCCCCC(=O)OCC(CCCCCC)CCCCCCCC] | 6.28 |

TABLE 3-continued
Representative Compounds of Formula (III)
| No. | Structure | pKa |
|---|---|---|
| III-18 | 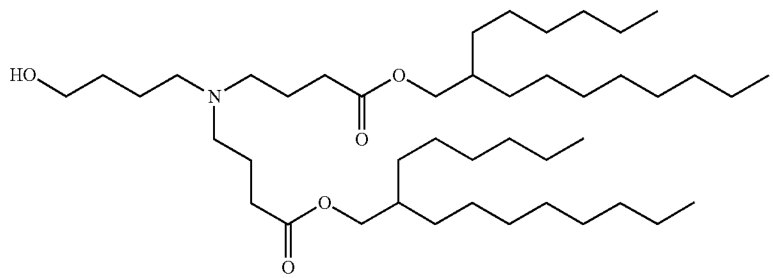 [SMILES: CCCCCCCCC(CCCCCC)COC(=O)CCCN(CCCCO)CCCC(=O)OCC(CCCCCC)CCCCCCCC] | — |
| III-19 | 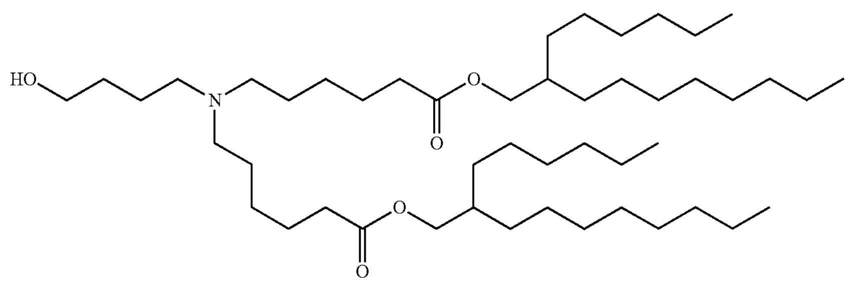 [SMILES: CCCCCCCCC(CCCCCC)COC(=O)CCCCCN(CCCCO)CCCCCC(=O)OCC(CCCCCC)CCCCCCCC] | — |
| III-20 | 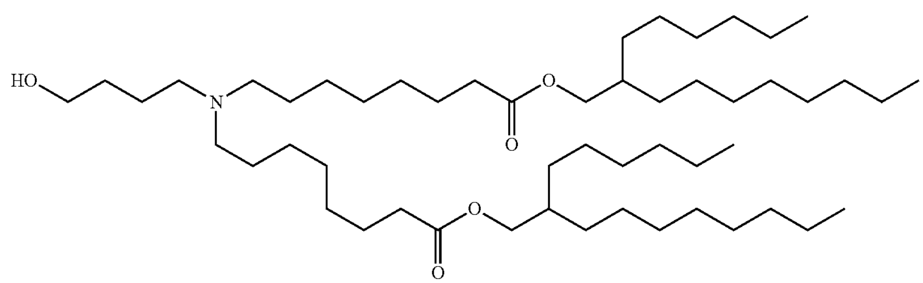 [SMILES: CCCCCCCCC(CCCCCC)COC(=O)CCCCCCCN(CCCCO)CCCCCCCC(=O)OCC(CCCCCC)CCCCCCCC] | 6.36 |
| III-21 | 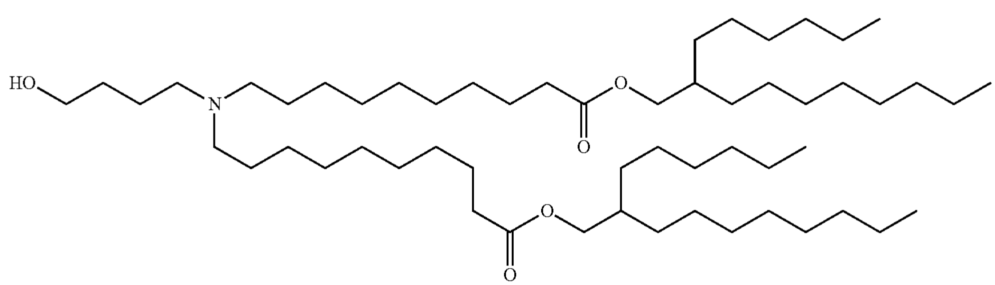 [SMILES: CCCCCCCCC(CCCCCC)COC(=O)CCCCCCCCCN(CCCCO)CCCCCCCCCC(=O)OCC(CCCCCC)CCCCCCCC] | — |
| III-22 | 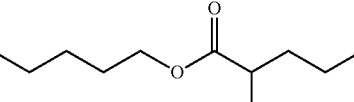 | 6.10 |

TABLE 3-continued

Representative Compounds of Formula (III)

| No. | Structure | pKa |
|---|---|---|
| III-23 | 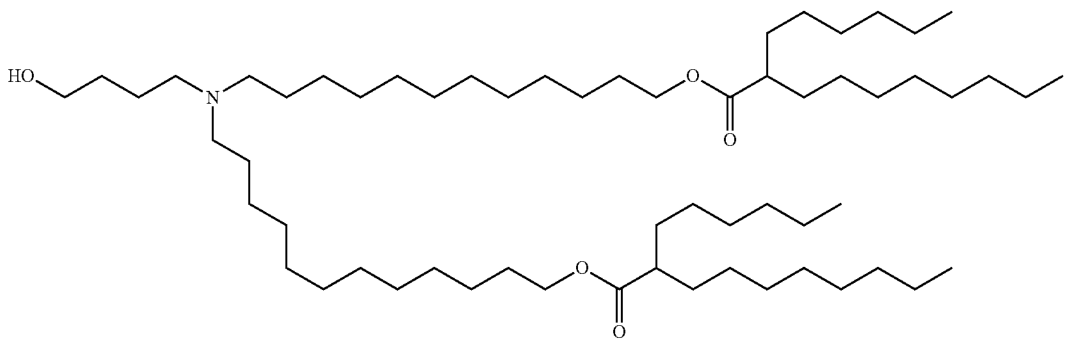 [SMILES: CCCCCCCCC(CCCCCC)C(=O)OCCCCCCCCCCCCN(CCCCO)CCCCCCCCCCCCOC(=O)C(CCCCCC)CCCCCCCC] | 5.98 |
| III-24 | 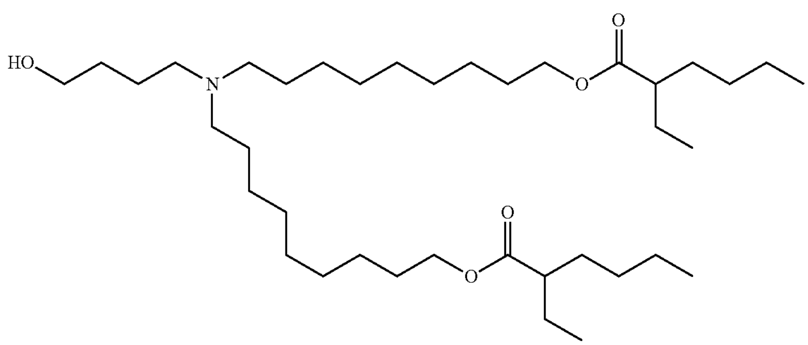 [SMILES: CCCCC(CC)C(=O)OCCCCCCCCCN(CCCCO)CCCCCCCCCOC(=O)C(CC)CCCC] | — |
| III-25 | 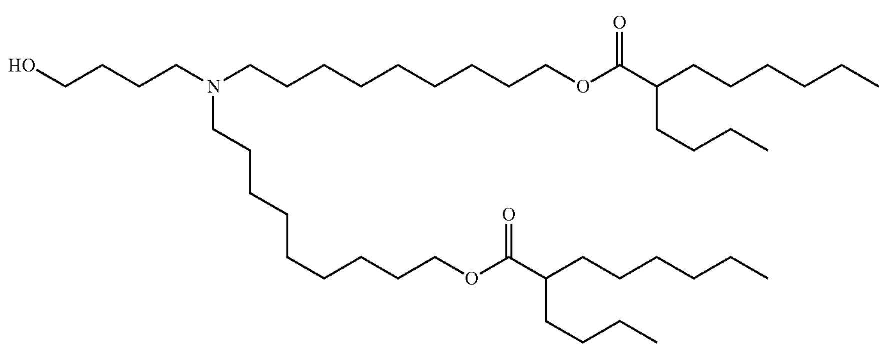 [SMILES: CCCCCCC(CCCC)C(=O)OCCCCCCCCCN(CCCCO)CCCCCCCCCOC(=O)C(CCCC)CCCCCC] | 6.22 |
| III-26 | 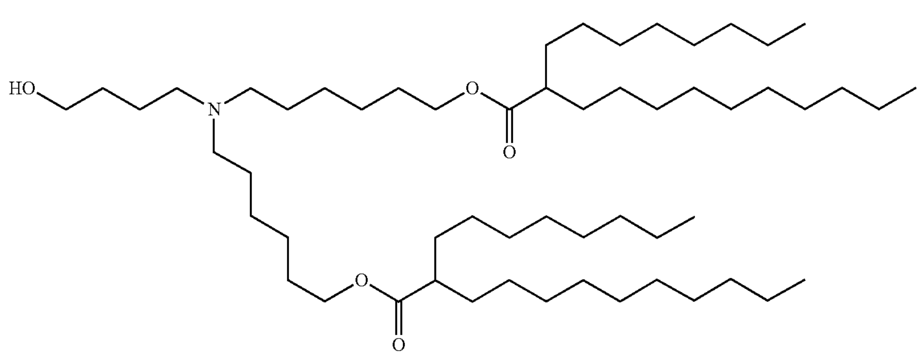 [SMILES: CCCCCCCCCCC(CCCCCCCC)C(=O)OCCCCCCN(CCCCO)CCCCCCOC(=O)C(CCCCCCCC)CCCCCCCCCC] | 5.84 |

TABLE 3-continued

Representative Compounds of Formula (III)

| No. | Structure | pKa |
|---|---|---|
| III-27 | 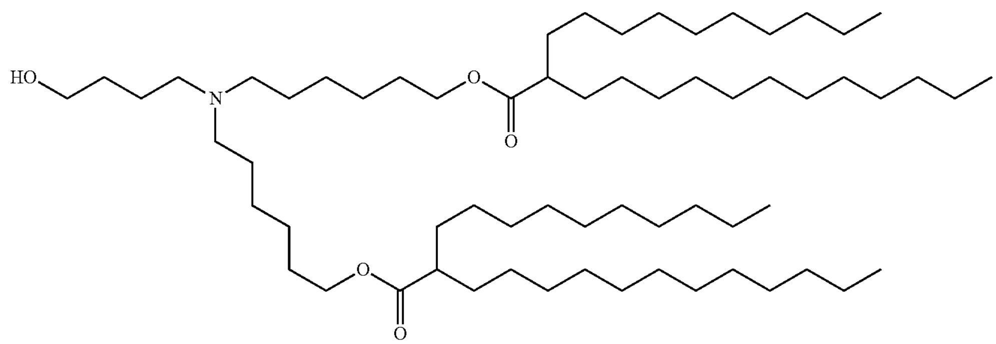 [SMILES: CCCCCCCCCCCCC(CCCCCCCCCC)C(=O)OCCCCCCN(CCCCO)CCCCCCOC(=O)C(CCCCCCCCCC)CCCCCCCCCCCC] | 5.77 |
| III-28 | 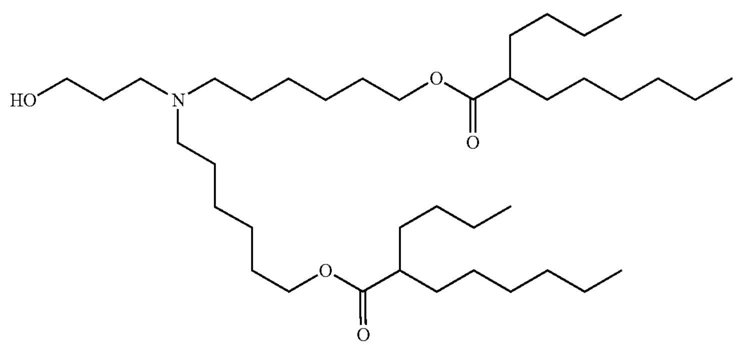 [SMILES: CCCCCCC(CCCC)C(=O)OCCCCCCN(CCCO)CCCCCCOC(=O)C(CCCC)CCCCCC] | — |
| III-29 | 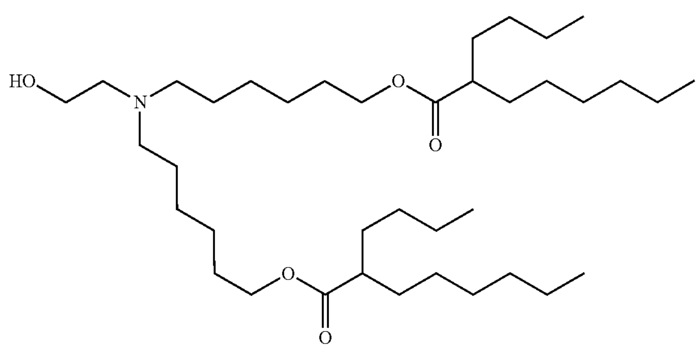 [SMILES: CCCCCCC(CCCC)C(=O)OCCCCCCN(CCO)CCCCCCOC(=O)C(CCCC)CCCCCC] | — |
| III-30 | 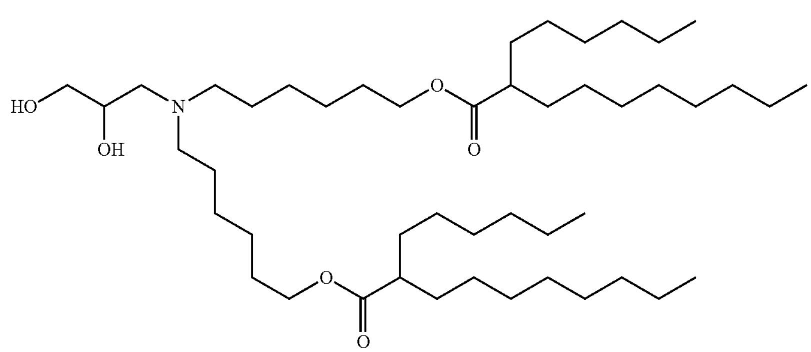 [SMILES: CCCCCCCCC(CCCCCC)C(=O)OCCCCCCN(CCCCCCOC(=O)C(CCCCCC)CCCCCCCC)CC(O)CO] | 6.09 |

TABLE 3-continued

Representative Compounds of Formula (III)

| No. | Structure | pKa |
|---|---|---|
| III-31 | 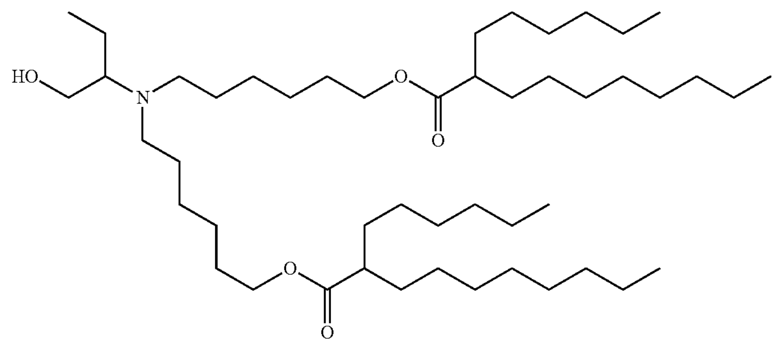 [SMILES: CCCCCCCCC(CCCCCC)C(=O)OCCCCCCN(CCCCCCOC(=O)C(CCCCCC)CCCCCCCC)C(CC)CO] | — |
| III-32 | 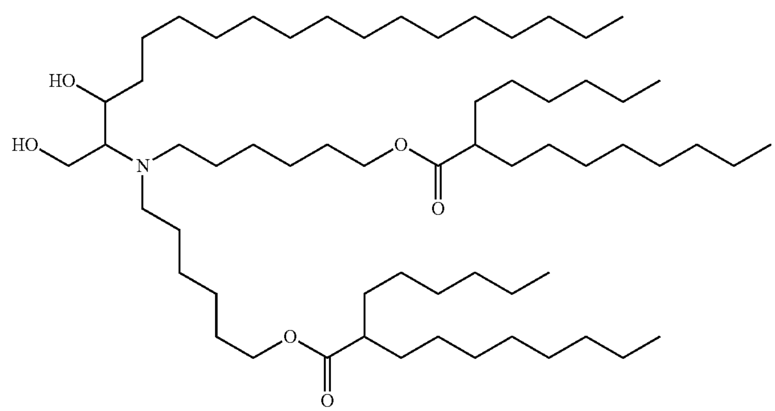 [SMILES: CCCCCCCCCCCCCCCC(O)C(CO)N(CCCCCCOC(=O)C(CCCCCC)CCCCCCCC)CCCCCCOC(=O)C(CCCCCC)CCCCCCCC] | — |
| III-33 | 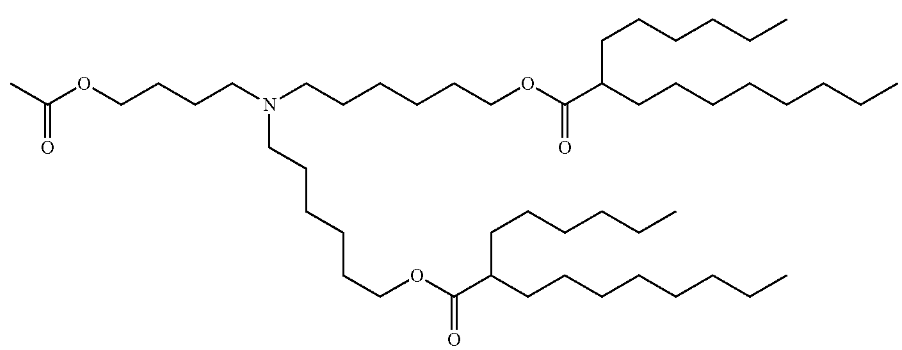 [SMILES: CCCCCCCCC(CCCCCC)C(=O)OCCCCCCN(CCCCCCOC(=O)C(CCCCCC)CCCCCCCC)CCCCOC(C)=O] | — |
| III-34 | 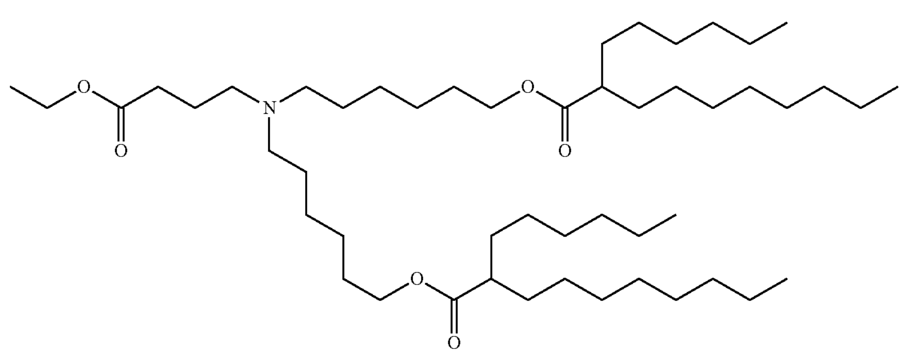 [SMILES: CCCCCCCCC(CCCCCC)C(=O)OCCCCCCN(CCCCCCOC(=O)C(CCCCCC)CCCCCCCC)CCCC(=O)OCC] | — |

TABLE 3-continued
| | Representative Compounds of Formula (III) | |
|---|---|---|
| No. | Structure | pKa |
| III-35 | 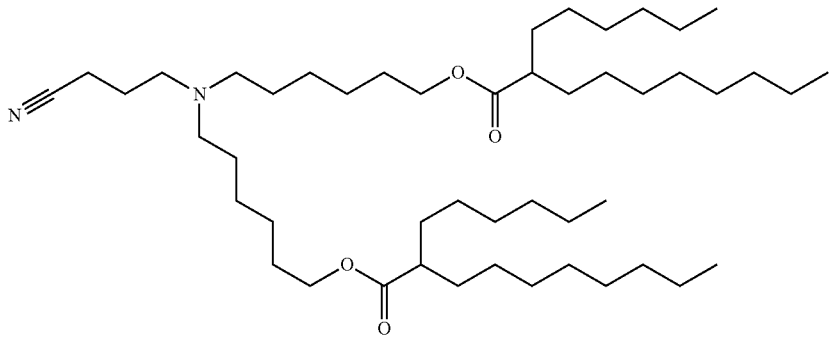 [SMILES: CCCCCCCCC(CCCCCC)C(=O)OCCCCCCN(CCCC#N)CCCCCCOC(=O)C(CCCCCC)CCCCCCCC] | — |
| III-36 | 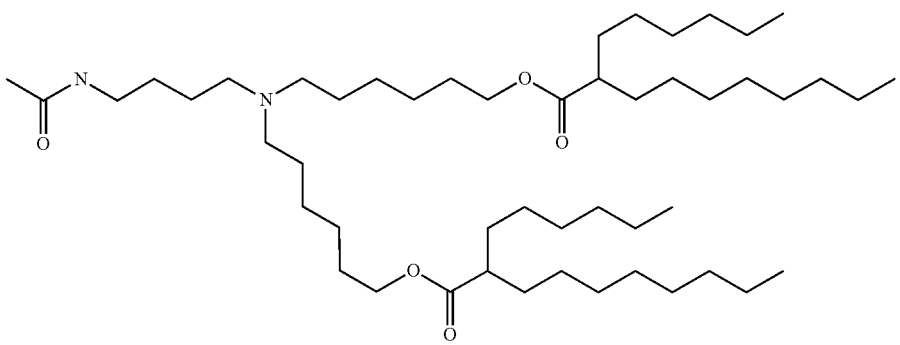 | — |
| III-37 | 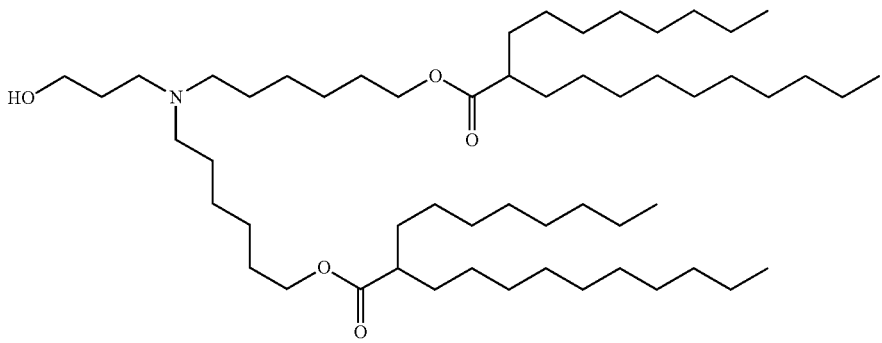 [SMILES: CCCCCCCCCCC(CCCCCCCC)C(=O)OCCCCCCN(CCCO)CCCCCCOC(=O)C(CCCCCCCC)CCCCCCCCCC] | — |
| III-38 | 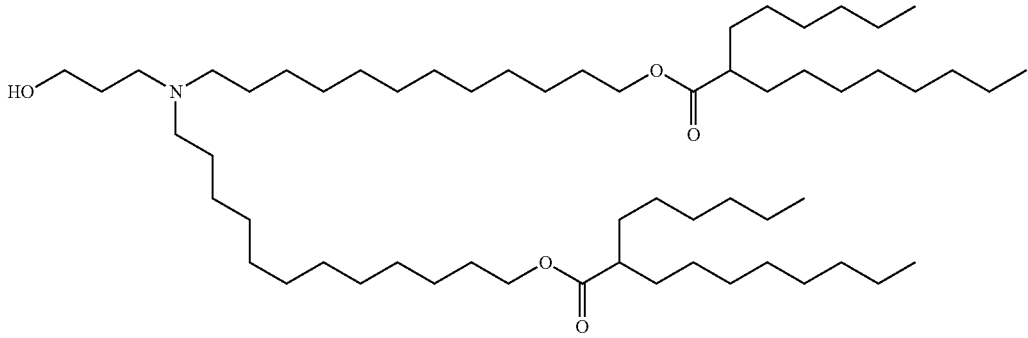 [SMILES: CCCCCCCCC(CCCCCC)C(=O)OCCCCCCCCCCCCN(CCCO)CCCCCCCCCCCCOC(=O)C(CCCCCC)CCCCCCCC] | — |

TABLE 3-continued

Representative Compounds of Formula (III)

| No. | Structure | pKa |
|---|---|---|
| III-39 | 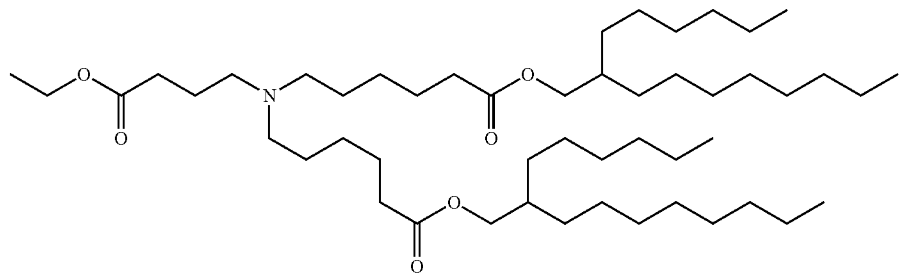 [SMILES: CCCCCCCCC(CCCCCC)COC(=O)CCCCCN(CCCCCC(=O)OCC(CCCCCC)CCCCCCCC)CCCC(=O)OCC] | — |
| III-40 | 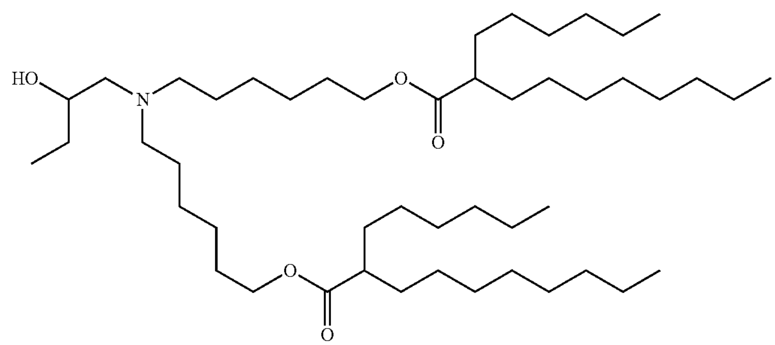 [SMILES: CCCCCCCCC(CCCCCC)C(=O)OCCCCCCN(CCCCCCOC(=O)C(CCCCCC)CCCCCCCC)CC(O)CC] | — |
| III-41 | 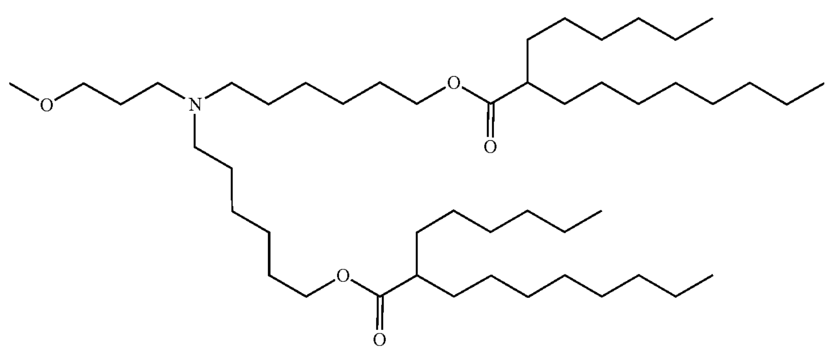 [SMILES: CCCCCCCCC(CCCCCC)C(=O)OCCCCCCN(CCCCCCOC(=O)C(CCCCCC)CCCCCCCC)CCCOC] | — |
| III-42 | 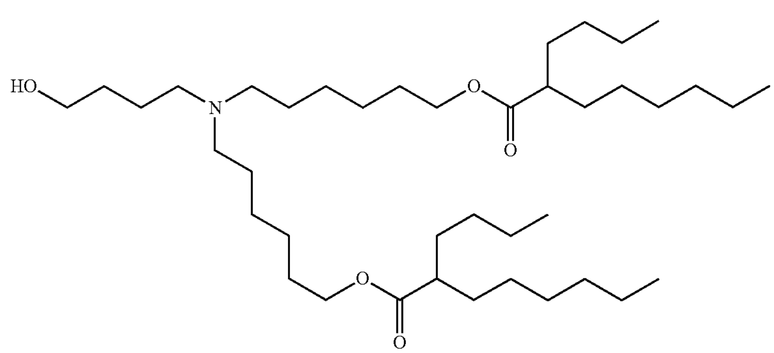 [SMILES: CCCCCCC(CCCC)C(=O)OCCCCCCN(CCCCO)CCCCCCOC(=O)C(CCCC)CCCCCC] | — |

TABLE 3-continued
Representative Compounds of Formula (III)
| No. | Structure | pKa |
|---|---|---|
| III-43 | 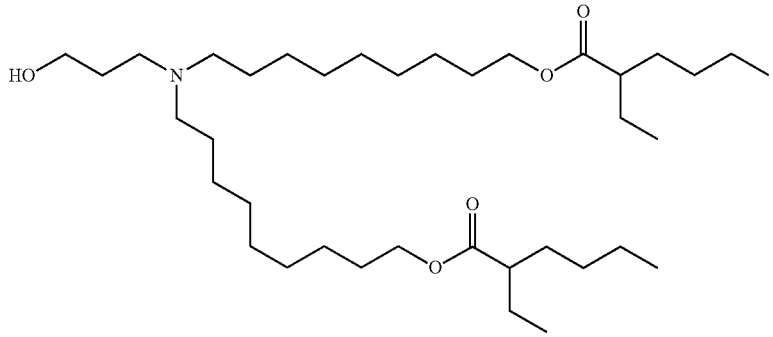 [SMILES: CCCCC(CC)C(=O)OCCCCCCCCCN(CCCO)CCCCCCCCCOC(=O)C(CC)CCCC] | — |
| III-44 | 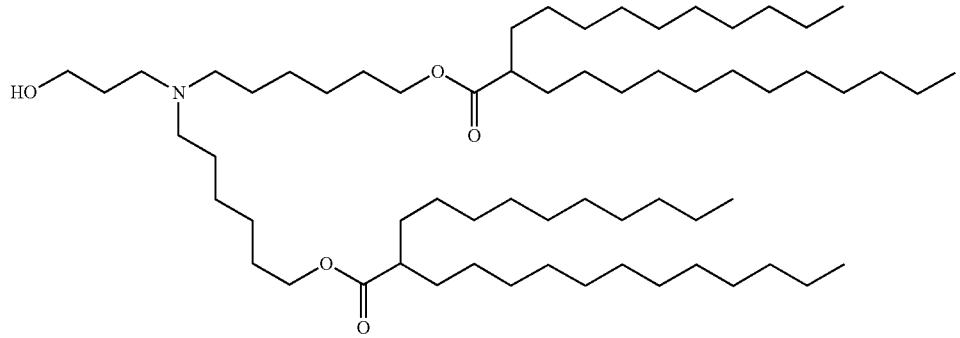 [SMILES: CCCCCCCCCCCCC(CCCCCCCCCC)C(=O)OCCCCCCN(CCCO)CCCCCCOC(=O)C(CCCCCCCCCC)CCCCCCCCCCCC] | — |
| III-45 | 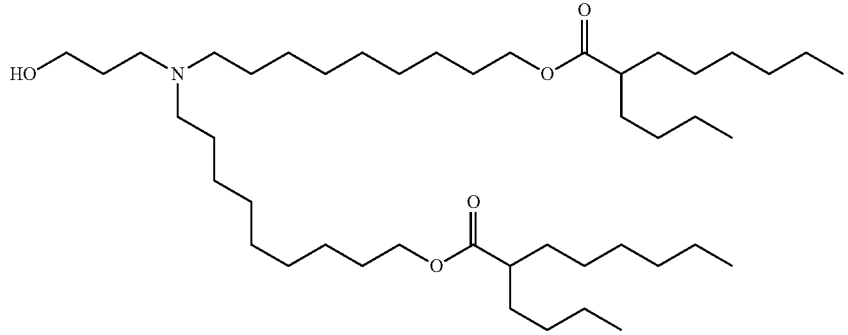 [SMILES: CCCCCCC(CCCC)C(=O)OCCCCCCCCCN(CCCO)CCCCCCCCCOC(=O)C(CCCC)CCCCCC] | — |
| III-46 | 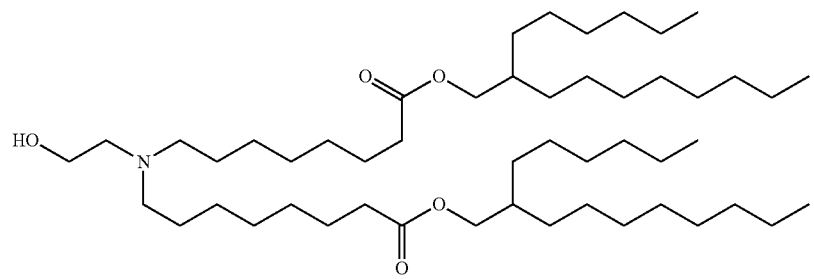 [SMILES: CCCCCCCCC(CCCCCC)COC(=O)CCCCCCCN(CCO)CCCCCCCC(=O)OCC(CCCCCC)CCCCCCCC] | — |

TABLE 3-continued

Representative Compounds of Formula (III)

| No. | Structure | pKa |
|---|---|---|
| III-47 | 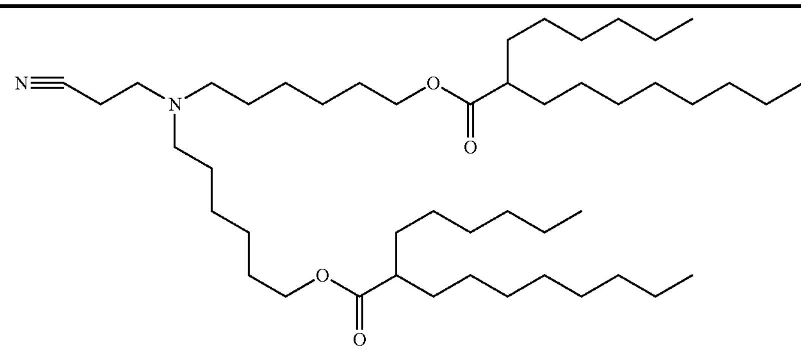 | — |
| III-48 | 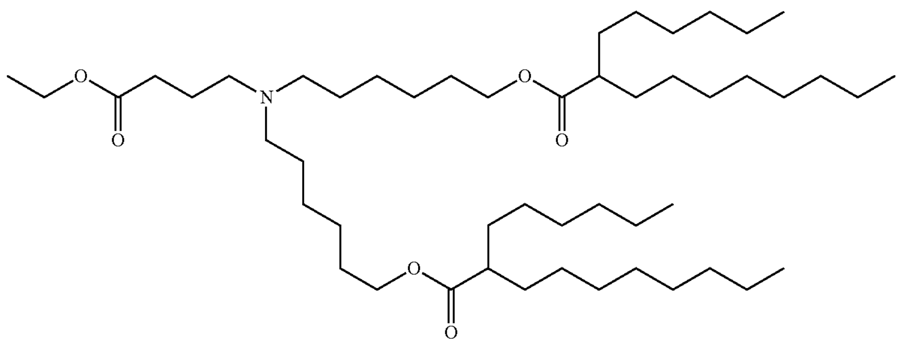 [SMILES: CCCCCCCCC(CCCCCC)C(=O)OCCCCCCN(CCCCCCOC(=O)C(CCCCCC)CCCCCCCC)CCCC(=O)OCC] | — |
| III-49 | 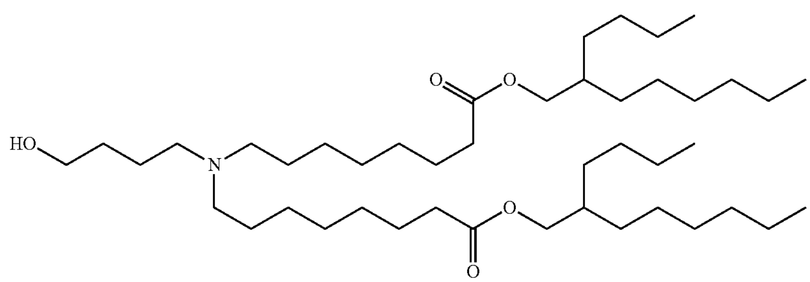 [SMILES: CCCCCCC(CCCC)COC(=O)CCCCCCCN(CCCCO)CCCCCCCC(=O)OCC(CCCC)CCCCCC] | — |

In one embodiment, the cationic lipid of any one of Embodiments 1, 2, 3,4 or 5 has a structure of Formula (IV):

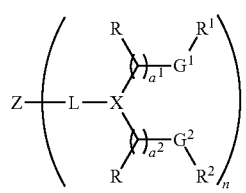

or a pharmaceutically acceptable salt, prodrug or stereoisomer thereof, wherein:

one of $G^1$ or $G^2$ is, at each occurrence, —O(C=O)—, —(C=O)O—, —C(=O)—, —O—, —S(O)$_y$—, —S—S—, —C(=O)S—, —SC(=O)—, —N(R$^a$)C(=O)—, —C(=O)N(R$^a$)—, —N(R$^a$)C(=O)N(R$^a$)—, —OC(=O)N(R$^a$)— or —N(R$^a$)C(=O)O—, and the other of $G^1$ or $G^2$ is, at each occurrence, —O(C=O)—, —(C=O)O—, —C(=O)—, —O—, —S(O)$_y$—, —S—S—, —C(=O)S—, —SC(=O)—, —N(R$^a$)C(=O)—, —C(=O)N(R$^a$)—, —N(R$^a$)C(=O)N(R$^a$)—, —OC(=O)N(R$^a$)— or —N(R$^a$)C(=O)O— or a direct bond;

L is, at each occurrence, ~O(C=O)—, wherein ~ represents a covalent bond to X;

X is CR$^a$;

Z is alkyl, cycloalkyl or a monovalent moiety comprising at least one polar functional group when n is 1; or Z is alkylene, cycloalkylene or a polyvalent moiety comprising at least one polar functional group when n is greater than 1;

R$^a$ is, at each occurrence, independently H, $C_1$-$C_{12}$ alkyl, $C_1$-$C_{12}$ hydroxylalkyl, $C_1$-$C_{12}$ aminoalkyl, $C_1$-$C_{12}$ alkylaminylalkyl, $C_1$-$C_{12}$ alkoxyalkyl, $C_1$-$C_{12}$ alkoxycarbonyl, $C_1$-$C_{12}$ alkylcarbonyloxy, $C_1$-$C_{12}$ alkylcarbonyloxyalkyl or $C_1$-$C_{12}$ alkylcarbonyl;

R is, at each occurrence, independently either: (a) H or $C_1$-$C_{12}$ alkyl; or (b) R together with the carbon atom to which it is bound is taken together with an adjacent R and the carbon atom to which it is bound to form a carbon-carbon double bond;

$R^1$ and $R^2$ have, at each occurrence, the following structure, respectively:

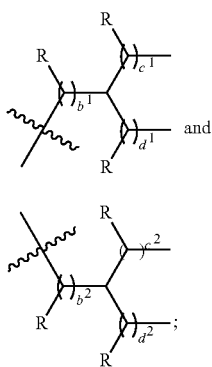

$a^1$ and $a^2$ are, at each occurrence, independently an integer from 3 to 12;

$b^1$ and $b^2$ are, at each occurrence, independently 0 or 1;

$c^1$ and $c^2$ are, at each occurrence, independently an integer from 5 to 10;

$d^1$ and $d^2$ are, at each occurrence, independently an integer from 5 to 10;

y is, at each occurrence, independently an integer from 0 to 2; and n is an integer from 1 to 6, wherein each alkyl, alkylene, hydroxylalkyl, aminoalkyl, alkylaminylalkyl, alkoxyalkyl, alkoxycarbonyl, alkylcarbonyloxy, alkylcarbonyloxyalkyl and alkylcarbonyl is optionally substituted with one or more substituent.

In some embodiments of Formula (IV), $G^1$ and $G^2$ are each independently —O(C=O)— or —(C=O)O—.

In other embodiments of Formula (IV), X is CH.

In different embodiments of Formula (IV), the sum of $a^1+b^1+c^1$ or the sum of $a^2+b^2+c^2$ is an integer from 12 to 26.

In still other embodiments of Formula (IV), $a^1$ and $a^2$ are independently an integer from 3 to 10. For example, in some embodiments $a^1$ and $a^2$ are independently an integer from 4 to 9.

In various embodiments of Formula (IV), $b^1$ and $b^2$ are 0. In different embodiments, $b^1$ and $b^2$ are 1.

In more embodiments of Formula (IV), $c^1$, $c^2$, $d^1$ and $d^2$ are independently an integer from 6 to 8.

In other embodiments of Formula (IV), c and $c^2$ are, at each occurrence, independently an integer from 6 to 10, and $d^1$ and $d^2$ are, at each occurrence, independently an integer from 6 to 10.

In other embodiments of Formula (IV), $c^1$ and $c^2$ are, at each occurrence, independently an integer from 5 to 9, and $d^1$ and $d^2$ are, at each occurrence, independently an integer from 5 to 9.

In more embodiments of Formula (IV), Z is alkyl, cycloalkyl or a monovalent moiety comprising at least one polar functional group when n is 1. In other embodiments, Z is alkyl.

In various embodiments of the foregoing Formula (IV), R is, at each occurrence, independently either: (a) H or methyl; or (b) R together with the carbon atom to which it is bound is taken together with an adjacent R and the carbon atom to which it is bound to form a carbon-carbon double bond. In certain embodiments, each R is H. In other embodiments at least one R together with the carbon atom to which it is bound is taken together with an adjacent R and the carbon atom to which it is bound to form a carbon-carbon double bond.

In other embodiments of the compound of Formula (IV), $R^1$ and $R^2$ independently have one of the following structures:

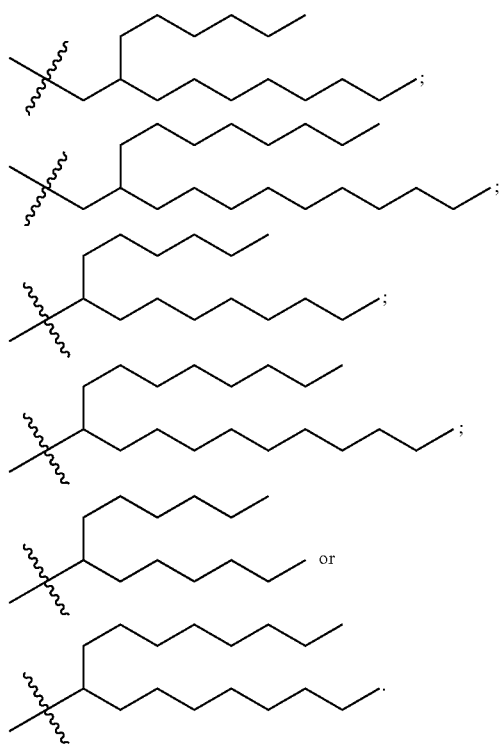

In certain embodiments of Formula (IV), the compound has one of the following structures:

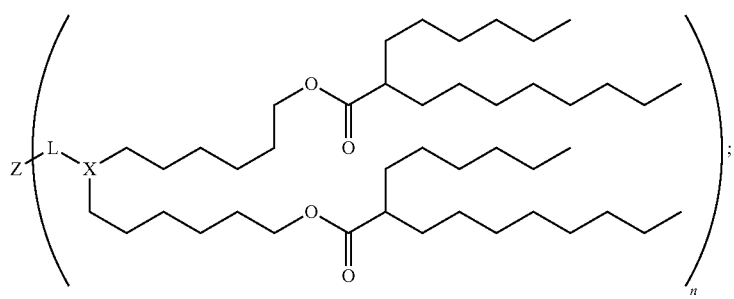

-continued
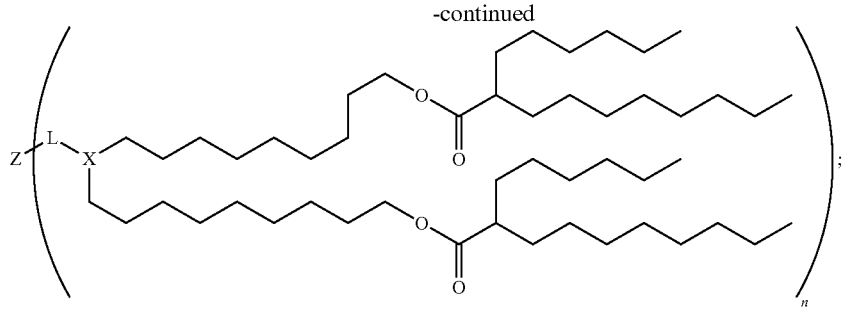
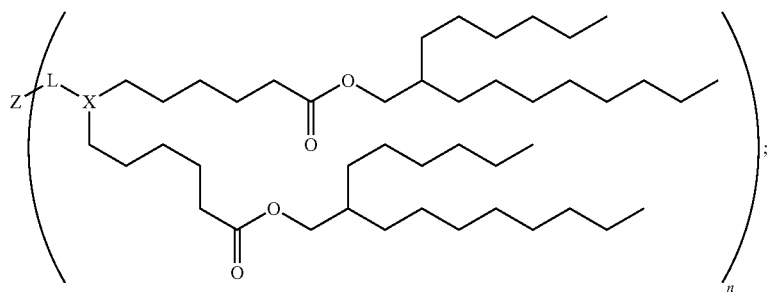
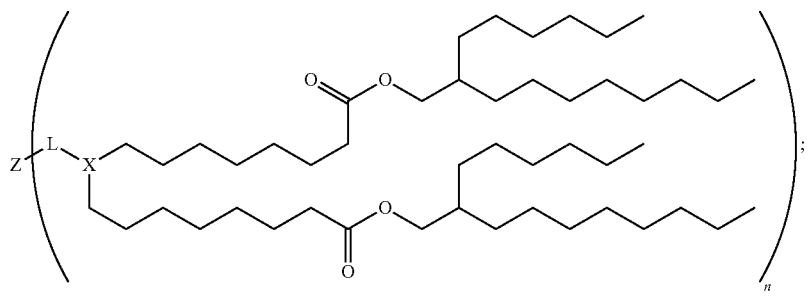
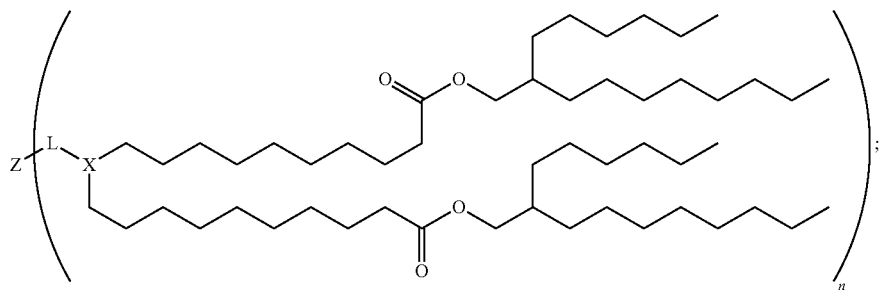
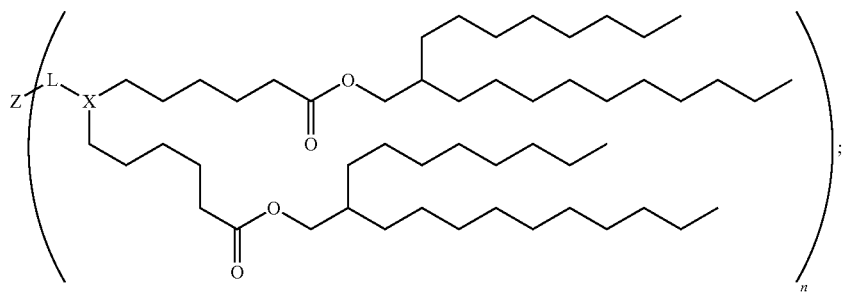

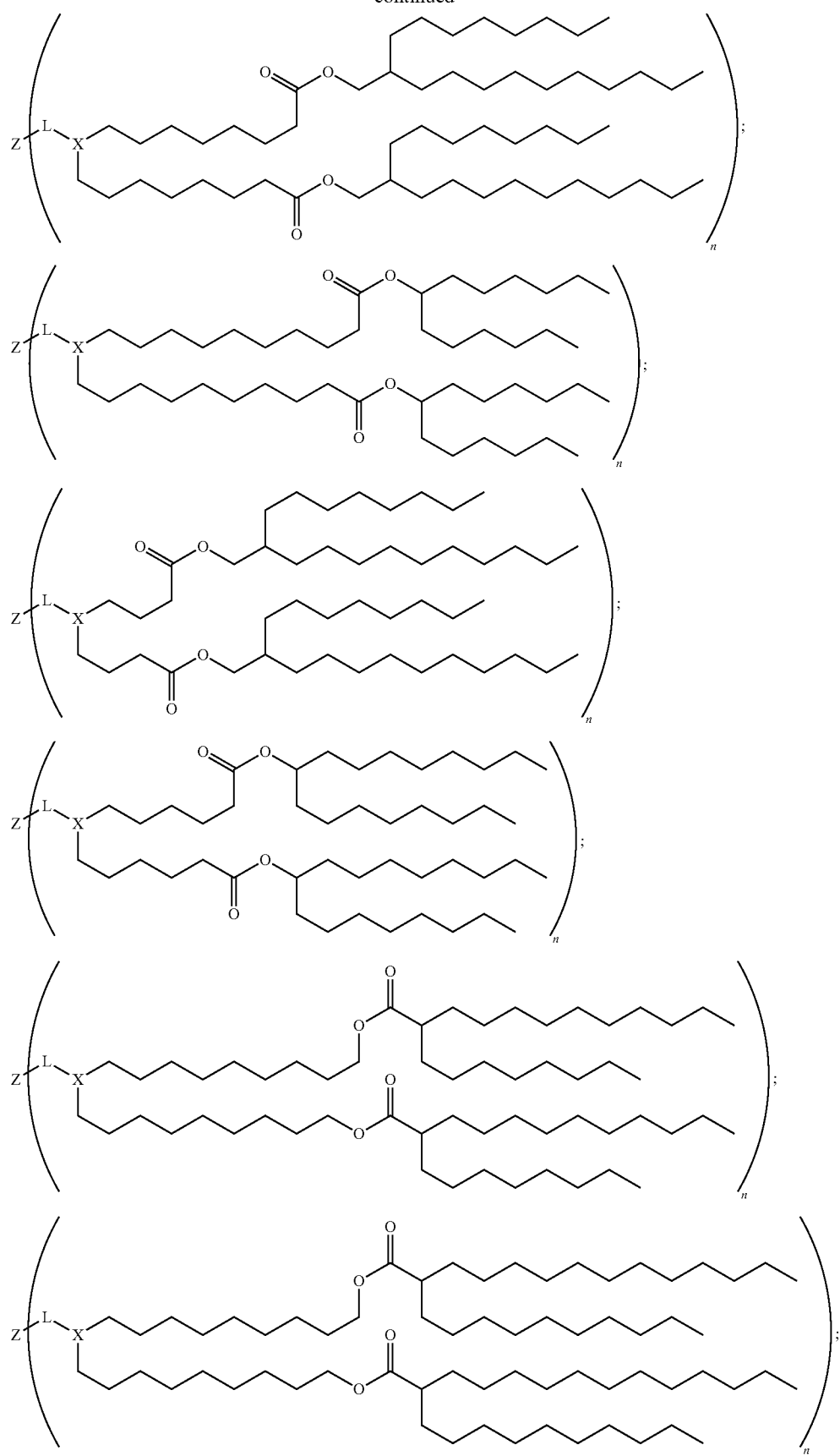

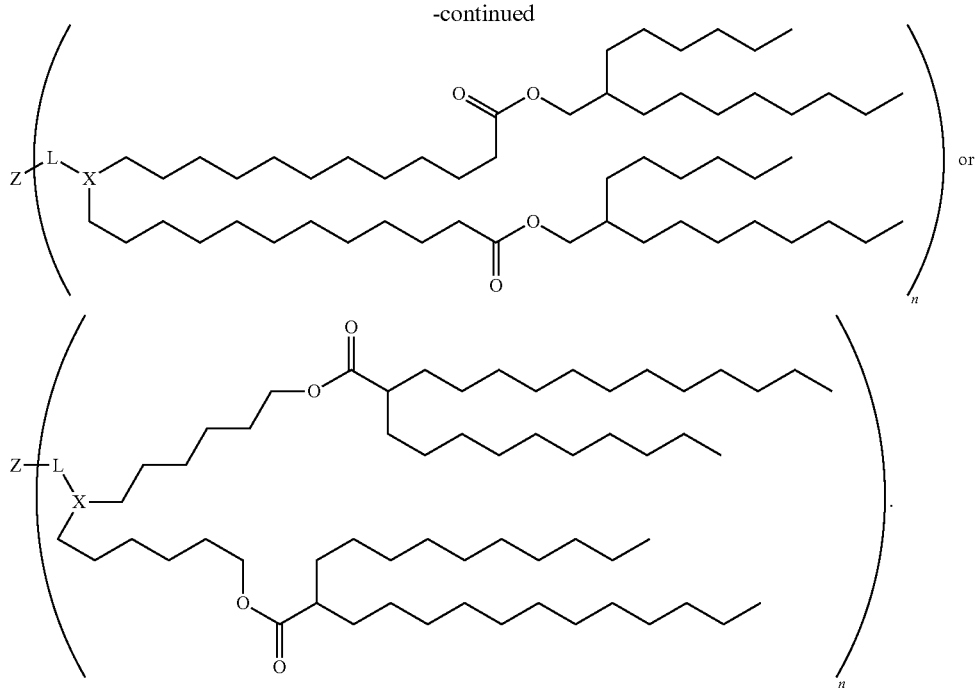

In still different embodiments the cationic lipid of Embodiments 1, 2, 3, 4 or 5 has the structure of Formula (V):

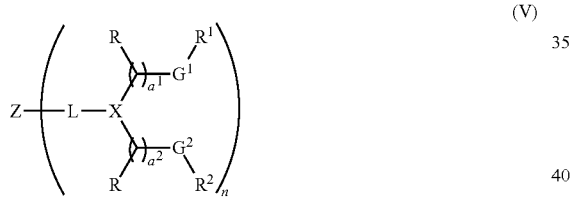

(V)

or a pharmaceutically acceptable salt, prodrug or stereoisomer thereof, wherein:

one of $G^1$ or $G^2$ is, at each occurrence, —O(C=O)—, —(C=O)O—, —C(=O)—, —O—, —S(O)$_y$—, —S—S—, —C(=O)S—, SC(=O)—, —N(R$^a$)C(=O)—, —C(=O)N(R$^a$)—, —N(R$^a$)C(=O)N(R$^a$)—, —OC(=O)N(R$^a$)— or —N(R$^a$)C(=O)O—, and the other of $G^1$ or $G^2$ is, at each occurrence, —O(C=O)—, —(C=O)O—, —C(=O)—, —O—, —S(O)—, —S—S—, —C(=O)S—, —SC(=O)—, —N(R$^a$)C(=O)—, —C(=O)N(R$^a$)—, —N(R$^a$)C(=O)N(R$^a$)—, —OC(=O)N(R$^a$)— or —N(R$^a$)C(=O)O— or a direct bond;

L is, at each occurrence, ~O(C=O)—, wherein ~ represents a covalent bond to X;

X is CR$^a$;

Z is alkyl, cycloalkyl or a monovalent moiety comprising at least one polar functional group when n is 1; or Z is alkylene, cycloalkylene or a polyvalent moiety comprising at least one polar functional group when n is greater than 1;

R$^a$ is, at each occurrence, independently H, $C_1$-$C_{12}$ alkyl, $C_1$-$C_{12}$ hydroxylalkyl, $C_1$-$C_{12}$ aminoalkyl, $C_1$-$C_{12}$ alkylaminylalkyl, $C_1$-$C_{12}$ alkoxyalkyl, $C_1$-$C_{12}$ alkoxycarbonyl, $C_1$-$C_{12}$ alkylcarbonyloxy, $C_1$-$C_{12}$ alkylcarbonyloxyalkyl or $C_1$-$C_{12}$ alkylcarbonyl;

R is, at each occurrence, independently either: (a) H or $C_1$-$C_{12}$ alkyl; or (b) R together with the carbon atom to which it is bound is taken together with an adjacent R and the carbon atom to which it is bound to form a carbon-carbon double bond;

$R^1$ and $R^2$ have, at each occurrence, the following structure, respectively:

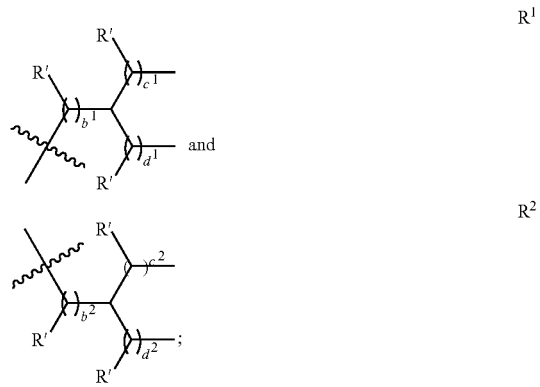

R' is, at each occurrence, independently H or $C_1$-$C_{12}$ alkyl;

$a^1$ and $a^2$ are, at each occurrence, independently an integer from 3 to 12;

$b^1$ and $b^2$ are, at each occurrence, independently 0 or 1;

$c^1$ and $c^2$ are, at each occurrence, independently an integer from 2 to 12;

$d^1$ and $d^2$ are, at each occurrence, independently an integer from 2 to 12;

y is, at each occurrence, independently an integer from 0 to 2; and n is an integer from 1 to 6, wherein $a^1$, $a^2$, $c^1$, $c^2$, $d^1$ and $d^2$ are selected such that the sum of $a^1$+$c^1$+$d^1$ is an integer from 18 to 30, and the sum of $a^2+c^2+d^2$ is an integer from 18 to 30, and wherein each alkyl, alkylene, hydroxylalkyl, aminoalkyl, alkylaminylalkyl, alkoxyalkyl, alkoxycarbonyl, alkylcarbonyloxy, alkylcarbonyloxyalkyl and alkylcarbonyl is optionally substituted with one or more substituent.

In certain embodiments of Formula (V), $G^1$ and $G^2$ are each independently —O(C═O)— or —(C═O)O—.

In other embodiments of Formula (V), X is CH.

In some embodiments of Formula (V), the sum of $a^1+c^1+d^1$ is an integer from 20 to 30, and the sum of $a^2+c^2+d^2$ is an integer from 18 to 30. In other embodiments, the sum of $a^1+c^1+d^1$ is an integer from 20 to 30, and the sum of $a^2+c^2+d^2$ is an integer from 20 to 30. In more embodiments of Formula (V), the sum of $a^1+b^1+c^1$ or the sum of $a^2+b^2+c^2$ is an integer from 12 to 26. In other embodiments, $a^1$, $a^2$, $c^1$, $c^2$, $d^1$ and $d^2$ are selected such that the sum of $a^1+c^1+d^1$ is an integer from 18 to 28, and the sum of $a^2+c^2+d^2$ is an integer from 18 to 28, In still other embodiments of Formula (V), $a^1$ and $a^2$ are independently an integer from 3 to 10, for example an integer from 4 to 9.

In yet other embodiments of Formula (V), $b^1$ and $b^2$ are 0. In different embodiments $b^1$ and $b^2$ are 1.

In certain other embodiments of Formula (V), $c^1$, $c^2$, $d^1$ and $d^2$ are independently an integer from 6 to 8.

In different other embodiments of Formula (V), Z is alkyl or a monovalent moiety comprising at least one polar functional group when n is 1; or Z is alkylene or a polyvalent moiety comprising at least one polar functional group when n is greater than 1

In more embodiments of Formula (V), Z is alkyl, cycloalkyl or a monovalent moiety comprising at least one polar functional group when n is 1. In other embodiments, Z is alkyl.

In other different embodiments of Formula (V), R is, at each occurrence, independently either: (a) H or methyl; or (b) R together with the carbon atom to which it is bound is taken together with an adjacent R and the carbon atom to which it is bound to form a carbon-carbon double bond. For example in some embodiments each R is H. In other embodiments at least one R together with the carbon atom to which it is bound is taken together with an adjacent R and the carbon atom to which it is bound to form a carbon-carbon double bond.

In more embodiments, each R' is H.

In certain embodiments of Formula (V), the sum of $a^1+c^1+d^1$ is an integer from 20 to 25, and the sum of $a^2+c^2+d^2$ is an integer from 20 to 25.

In other embodiments of Formula (V), $R^1$ and $R^2$ independently have one of the following structures:

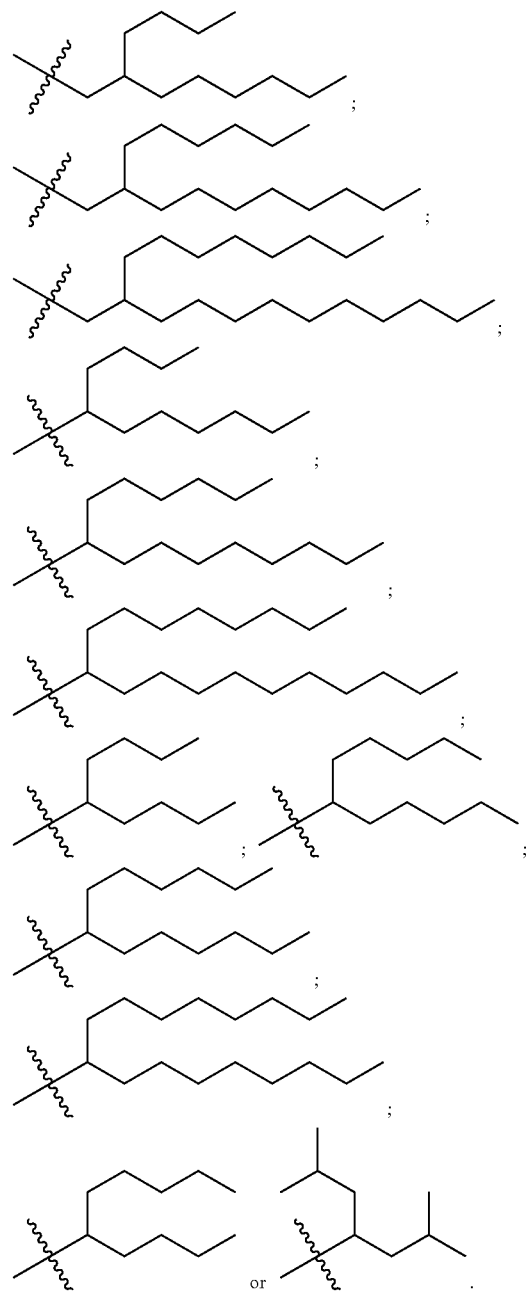

In more embodiments of Formula (V), the compound has one of the following structures:

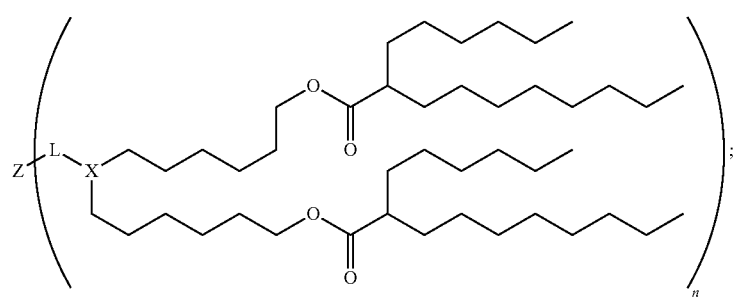

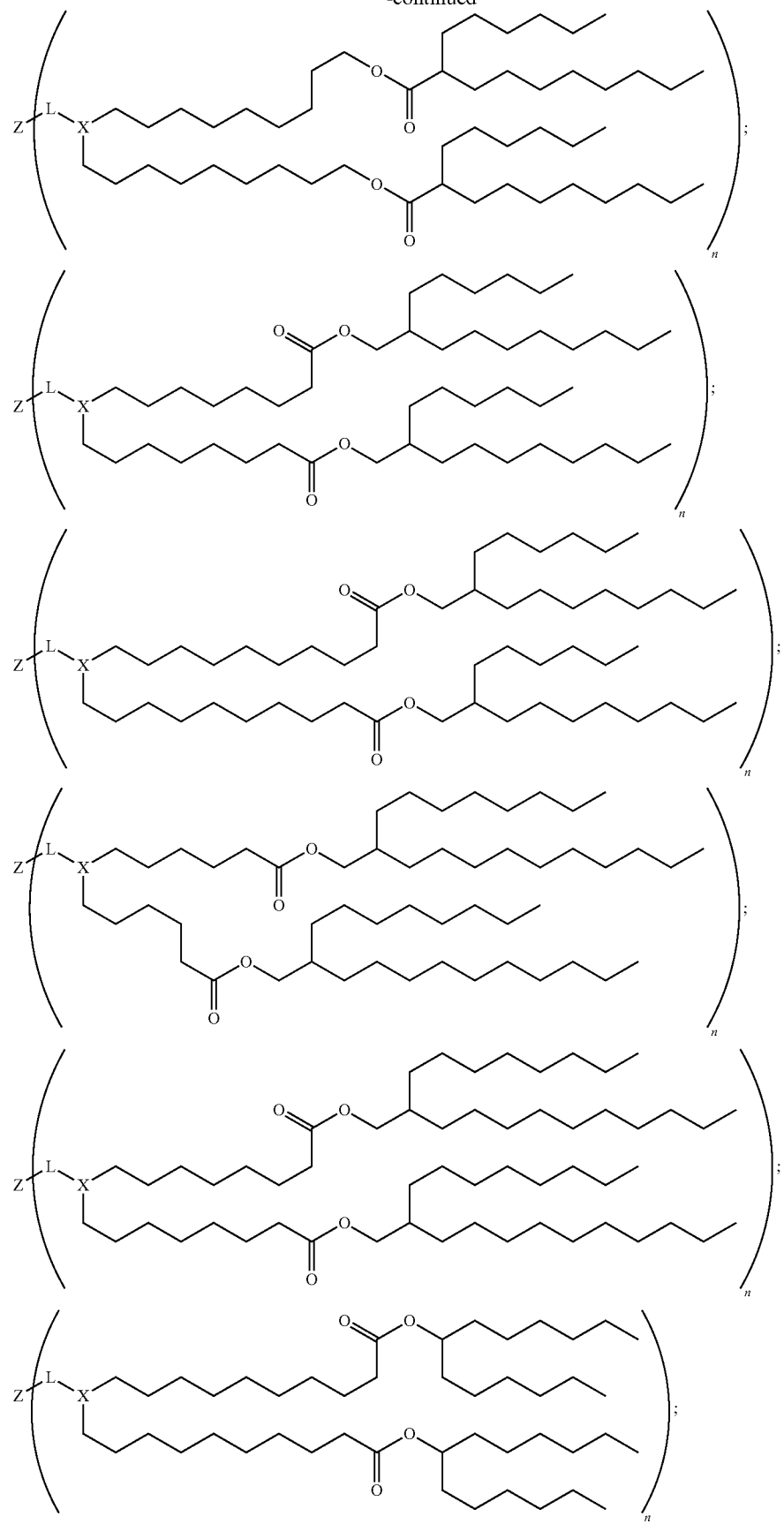

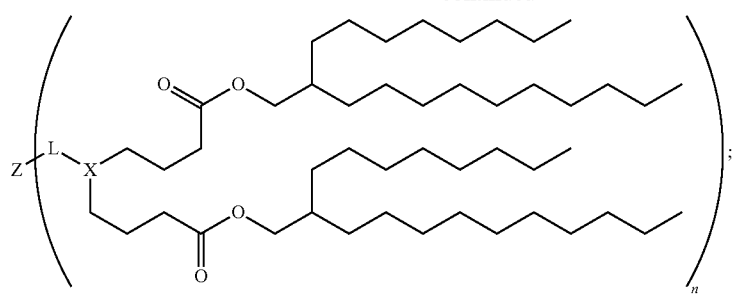
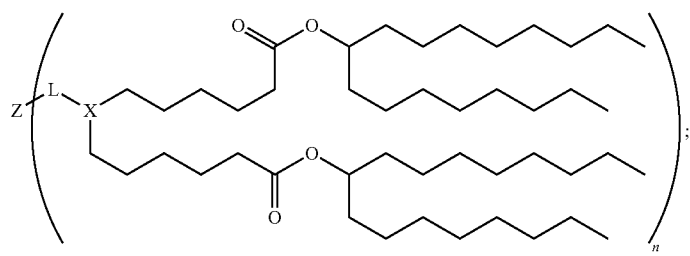
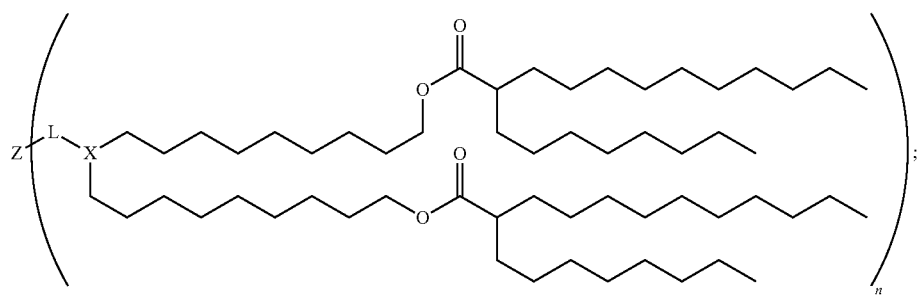
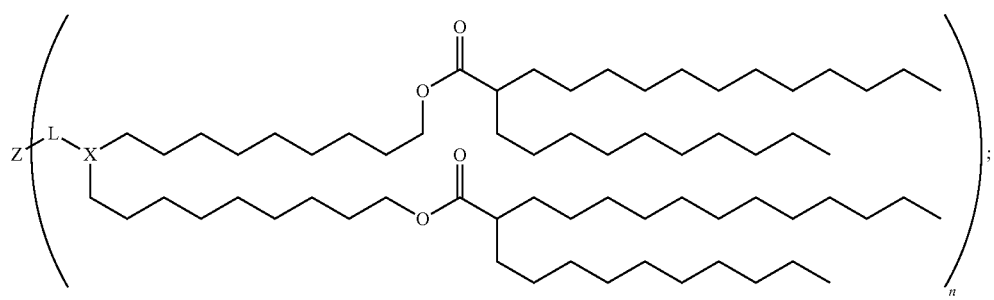
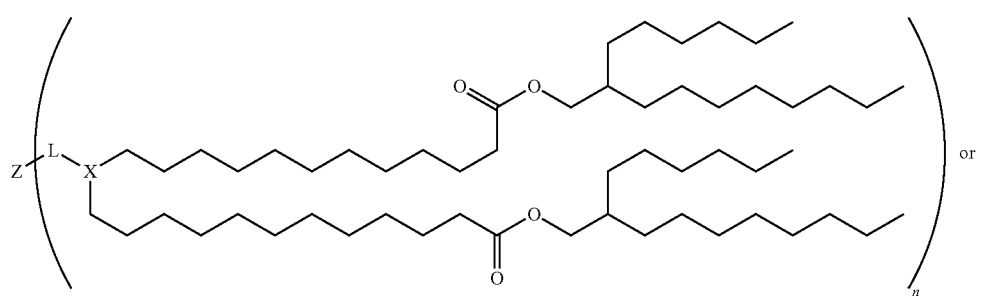

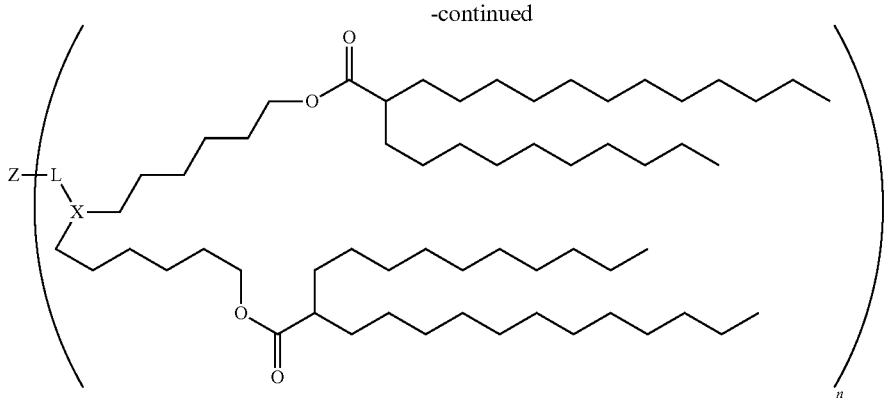

In any of the foregoing embodiments of Formula (IV) or (V), n is 1. In other of the foregoing embodiments of Formula (IV) or (V), n is greater than 1.

In more of any of the foregoing embodiments of Formula (IV) or (V), Z is a mono- or polyvalent moiety comprising at least one polar functional group. In some embodiments, Z is a monovalent moiety comprising at least one polar functional group. In other embodiments, Z is a polyvalent moiety comprising at least one polar functional group.

In more of any of the foregoing embodiments of Formula (IV) or (V), the polar functional group is a hydroxyl, alkoxy, ester, cyano, amide, amino, alkylaminyl, heterocyclyl or heteroaryl functional group.

In any of the foregoing embodiments of Formula (IV) or (V), Z is hydroxyl, hydroxylalkyl, alkoxyalkyl, amino, aminoalkyl, alkylaminyl, alkylaminylalkyl, heterocyclyl or heterocyclylalkyl.

In some other embodiments of Formula (IV) or (V), Z has the following structure:

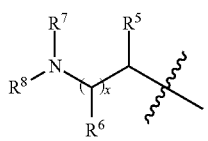

wherein:
$R^5$ and $R^6$ are independently H or $C_1$-$C_6$ alkyl;
$R^7$ and $R^8$ are independently H or $C_1$-$C_6$ alkyl or $R^7$ and $R^8$, together with the nitrogen atom to which they are attached, join to form a 3-7 membered heterocyclic ring; and
x is an integer from 0 to 6.

In still different embodiments of Formula (IV) or (V), Z has the following structure:

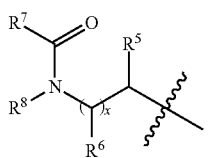

wherein:
$R^5$ and $R^6$ are independently H or $C_1$-$C_6$ alkyl;
$R^7$ and $R^8$ are independently H or $C_1$-$C_6$ alkyl or $R^7$ and $R^8$, together with the nitrogen atom to which they are attached, join to form a 3-7 membered heterocyclic ring; and
x is an integer from 0 to 6.

In still different embodiments of formula (IV) or (V), Z has the following structure:

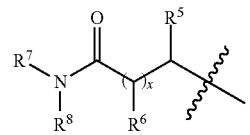

wherein:
$R^5$ and $R^6$ are independently H or $C_1$-$C_6$ alkyl;
$R^7$ and $R^8$ are independently H or $C_1$-$C_6$ alkyl or $R_7$ and $R^8$, together with the nitrogen atom to which they are attached, join to form a 3-7 membered heterocyclic ring; and
x is an integer from 0 to 6.

In some other embodiments of Formula (IV) or (V), Z is hydroxylalkyl, cyanoalkyl or an alkyl substituted with one or more ester or amide groups.

For example, in any of the foregoing embodiments of Formula (IV) or (V), Z has one of the following structures:

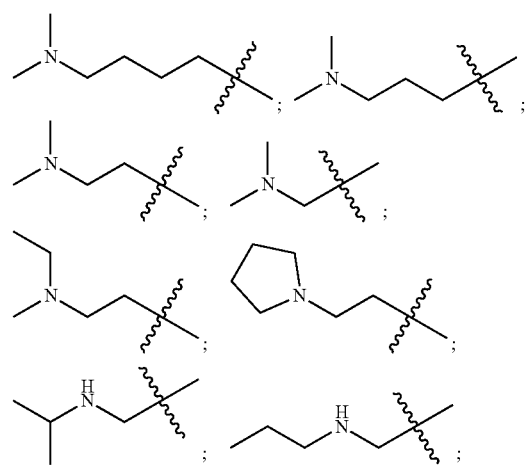

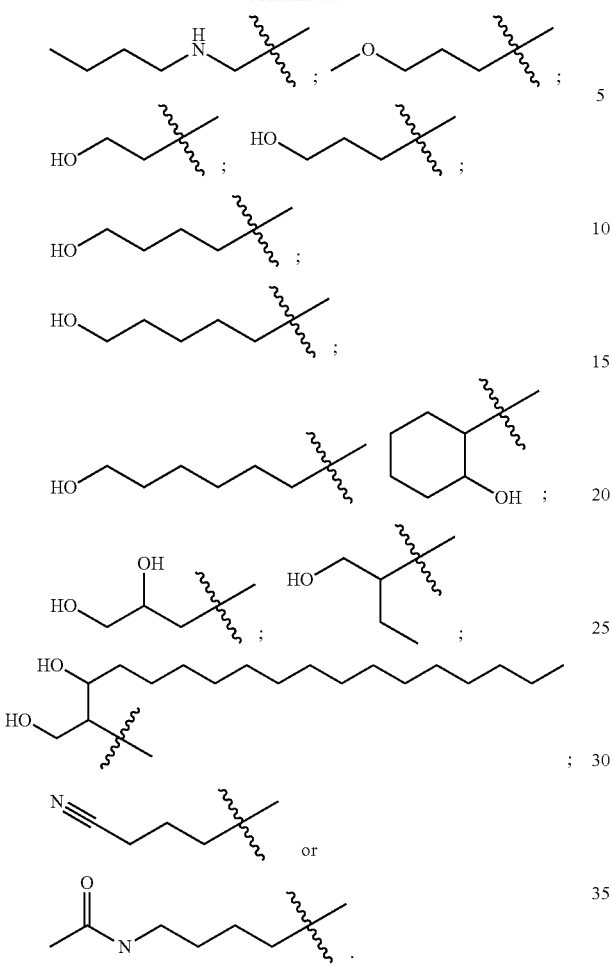
In other embodiments of Formula (IV) or (V), Z-L has one of the following structures:
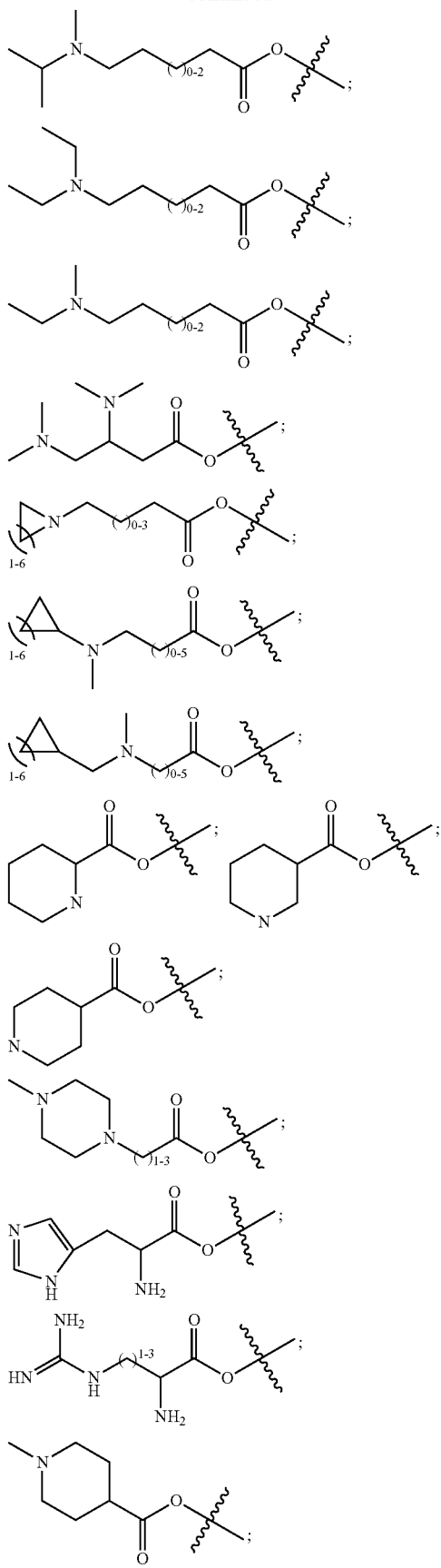

197
-continued
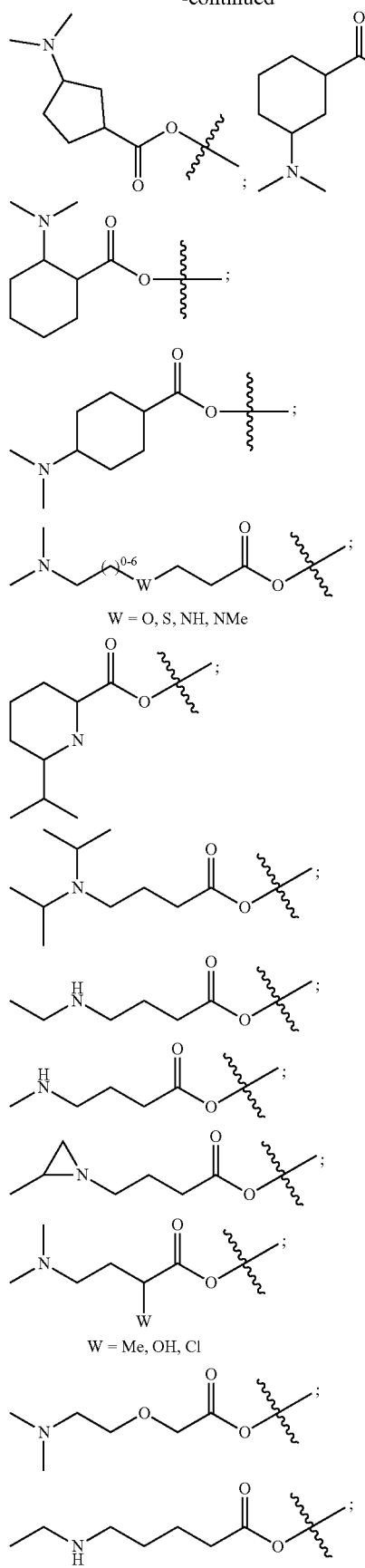
198
-continued
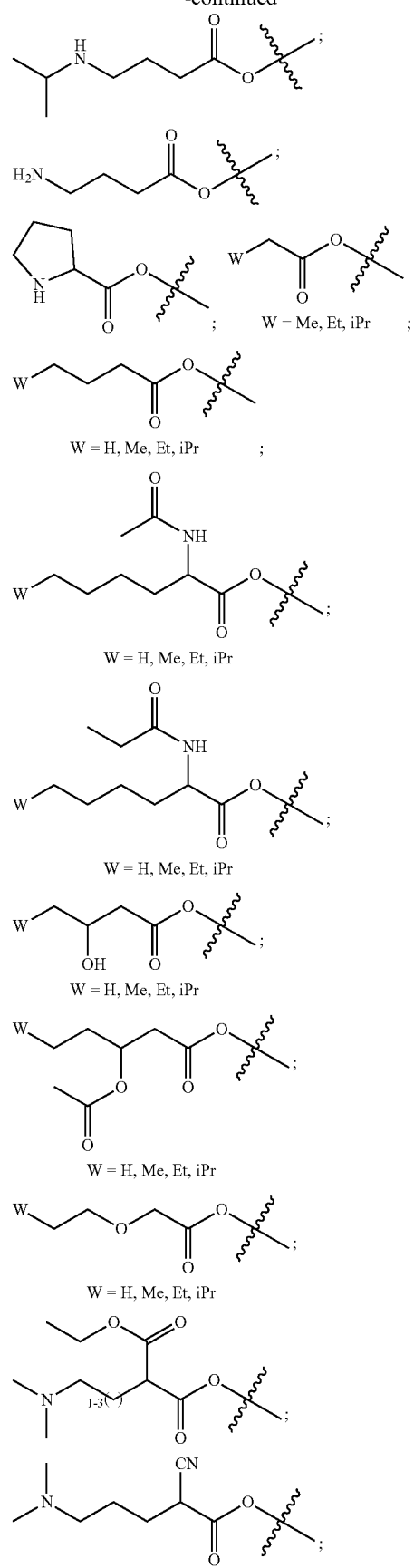

-continued
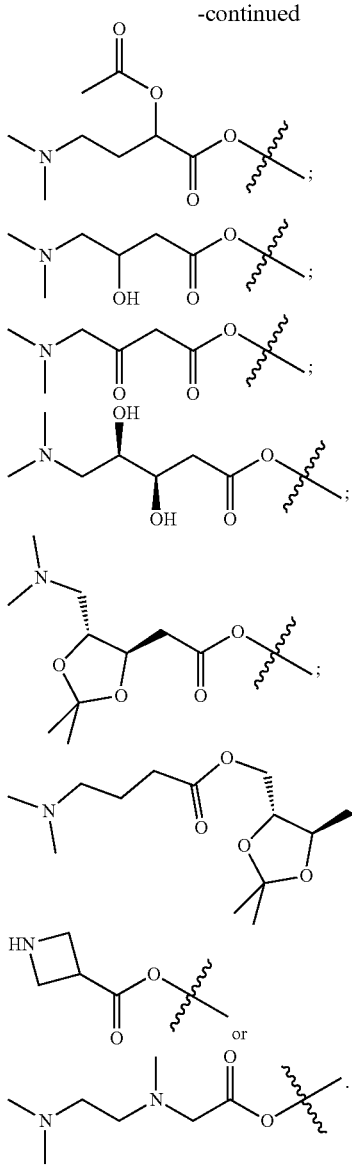
In other embodiments, Z-L has one of the following structures:
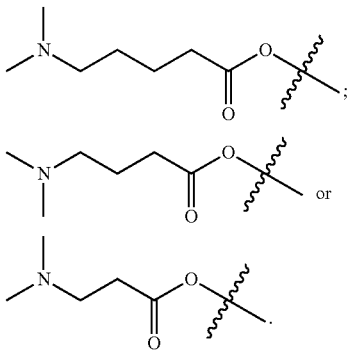
In still other embodiments, X is CH and Z-L has one of the following structures:
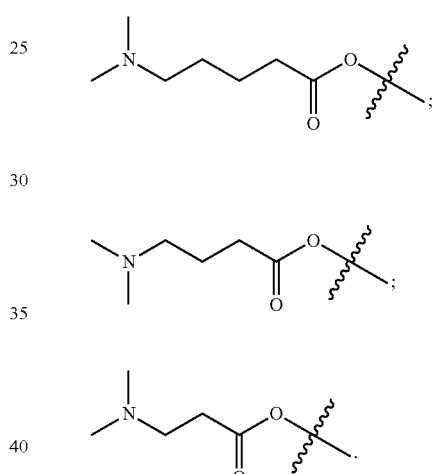
In various different embodiments, a cationic lipid of any one Embodiments 1, 2, 3, 4 or 5 has one of the structures set forth in Table 4 below.
TABLE 4
Representative Compounds of Formula (IV) or (V)
| No. | Structure |
|---|---|
| IV-1 | 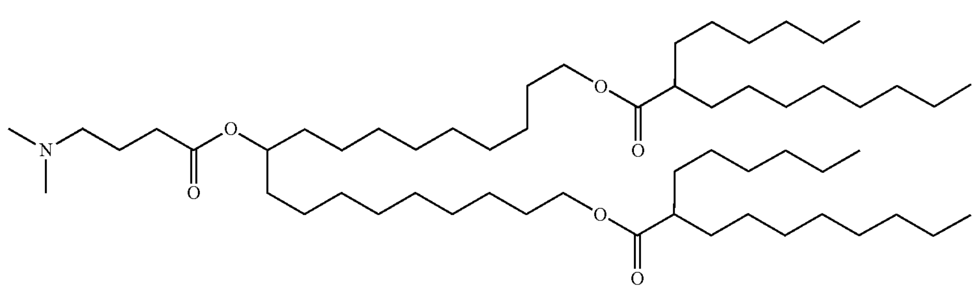 [SMILES: CCCCCCCCC(CCCCCC)C(=O)OCCCCCCCCCC(CCCCCCCCCOC(=O)C(CCCCCC)CCCCCCCC)OC(=O)CCCN(C)C] |

TABLE 4-continued

Representative Compounds of Formula (IV) or (V)

| No. | Structure |
|---|---|
| IV-2 | 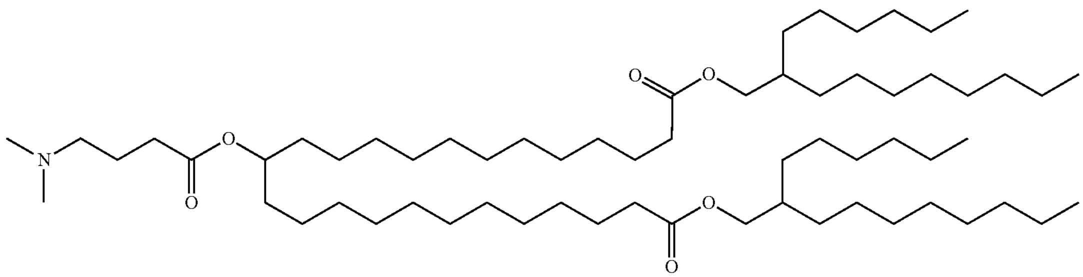 [SMILES: CCCCCCCCC(CCCCCC)COC(=O)CCCCCCCCCCCC(CCCCCCCCCCCC(=O)OCC(CCCCCC)CCCCCCCC)OC(=O)CCCN(C)C] |
| IV-3 | 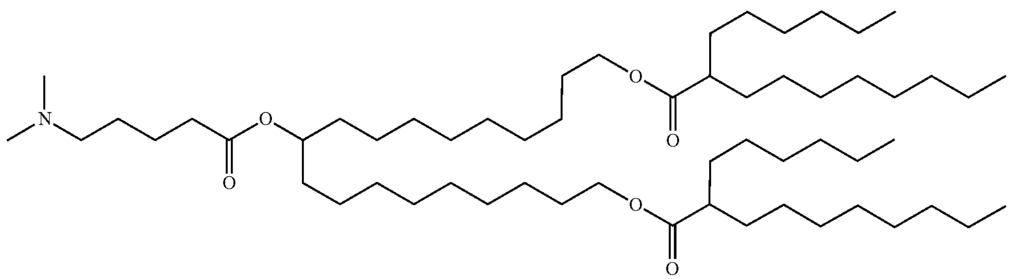 [SMILES: CCCCCCCCC(CCCCCC)C(=O)OCCCCCCCCCC(CCCCCCCCCOC(=O)C(CCCCCC)CCCCCCCC)OC(=O)CCCCN(C)C] |

In one embodiment, the cationic lipid is a compound having the following structure (VI):

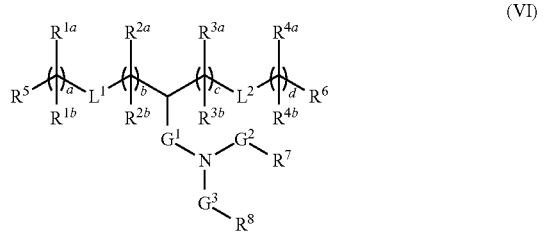

(VI)

or a pharmaceutically acceptable salt, tautomer, prodrug or stereoisomer thereof, wherein:

$L^1$ and $L^2$ are each independently —O(C=O)—, —(C=O)O—, —C(=O)—, —O—, —S(O)$_x$—, —S—S—, —C(=O)S—, —SC(=O)—, —NR$^a$C(=O)—, —C(=O)NR$^a$—, —NR$^a$C(=O)NR$^a$—, —OC(=O)NR$^a$—, —NR$^a$C(=O)O— or a direct bond;

$G^1$ is $C_1$-$C_2$ alkylene, —(C=O)—, —O(C=O)—, —SC(=O)—, —NR$^a$C(=O)— or a direct bond;

$G^2$ is —C(=O)—, —(C=O)O—, —C(=O)S—, —C(=O)NR$^a$— or a direct bond;

$G^3$ is $C_1$-$C_6$ alkylene;

$R^a$ is H or $C_1$-$C_{12}$ alkyl;

$R^{1a}$ and $R^{1b}$ are, at each occurrence, independently either:
(a) H or $C_1$-$C_{12}$ alkyl; or (b) $R^{1a}$ is H or $C_1$-$C_{12}$ alkyl, and $R^{1b}$ together with the carbon atom to which it is bound is taken together with an adjacent $R^{1b}$ and the carbon atom to which it is bound to form a carbon-carbon double bond;

$R^{2a}$ and $R^{2b}$ are, at each occurrence, independently either:
(a) H or $C_1$-$C_{12}$ alkyl; or (b) $R^{2a}$ is H or $C_1$-$C_{12}$ alkyl, and $R^{2b}$ together with the carbon atom to which it is bound is taken together with an adjacent $R^{2b}$ and the carbon atom to which it is bound to form a carbon-carbon double bond;

$R^{3a}$ and $R^{3b}$ are, at each occurrence, independently either
(a): H or $C_1$-$C_{12}$ alkyl; or (b) $R^{3a}$ is H or $C_1$-$C_{12}$ alkyl, and $R^{3b}$ together with the carbon atom to which it is bound is taken together with an adjacent $R^{3b}$ and the carbon atom to which it is bound to form a carbon-carbon double bond;

$R^{4a}$ and $R^{4b}$ are, at each occurrence, independently either:
(a) H or $C_1$-$C_{12}$ alkyl; or (b) $R^{4a}$ is H or $C_1$-$C_{12}$ alkyl, and $R^{4b}$ together with the carbon atom to which it is bound is taken together with an adjacent $R^{4b}$ and the carbon atom to which it is bound to form a carbon-carbon double bond;

$R^5$ and $R^6$ are each independently H or methyl;

$R^7$ is H or $C_1$-$C_{20}$ alkyl;

$R_8$ is OH, —N(R$^9$)(C=O)R$^{10}$, —(C=O)NR$^9$R$^{10}$, —NR$^9$R$^{10}$, —(C=O)OR$^{11}$ or —O(C=O)R$^{11}$, provided that $G^3$ is $C_4$-$C_6$ alkylene when $R^8$ is —NR$^9$R$^{10}$, $R^9$ and $R^{10}$ are each independently H or $C_1$-$C_{12}$ alkyl;

$R^{11}$ is aralkyl;

a, b, c and d are each independently an integer from 1 to 24; and x is 0, 1 or 2, wherein each alkyl, alkylene and aralkyl is optionally substituted.

In some embodiments of structure (VI), $L^1$ and $L^2$ are each independently —O(C=O)—, —(C=O)O— or a direct bond. In other embodiments, $G^1$ and $G^2$ are each independently —(C=O)— or a direct bond. In some different embodiments, L1 and $L^2$ are each independently —O(C=O)—, —(C=O)O— or a direct bond; and $G^1$ and $G^2$ are each independently —(C=O)— or a direct bond.

In some different embodiments of structure (VI), $L^1$ and $L^2$ are each independently —C(=O)—, —O—, —S(O)$_x$—, —S—S—, —C(=O)S—, —SC(=O)—, —NR$^a$—, —NR$^a$C(=O)—, —C(=O)NR$^a$—, —NR$^a$C(=O)NR$^a$, —OC(=O)NR$^a$—, —NR$^a$C(=O)O—, —NR$^a$S(O)$_x$NR$^a$—, —NR$^a$S(O)$_x$— or —S(O)$_x$NR$^a$—.

In other of the foregoing embodiments of structure (VI), the compound has one of the following structures (VIA) or (VIB).

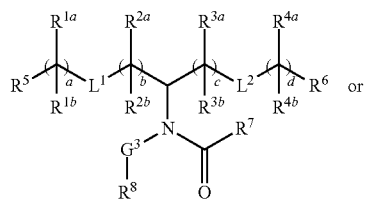
(VIA)

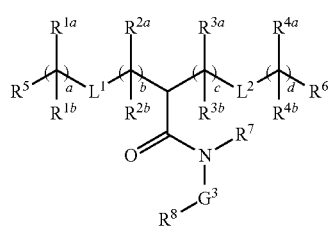
(VIB)

In some embodiments, the compound has structure (VIA). In other embodiments, the compound has structure (VIB).

In any of the foregoing embodiments of structure (VI), one of L$^1$ or L$^2$ is —O(C=O)—. For example, in some embodiments each of L$^1$ and L$^2$ are —O(C=O)—.

In some different embodiments of any of the foregoing, one of L$^1$ or L$^2$ is —(C=O)O—. For example, in some embodiments each of L$^1$ and L$^2$ is —(C=O)O—.

In different embodiments of structure (VI), one of L$^1$ or L$^2$ is a direct bond. As used herein, a "direct bond" means the group (e.g., L$^1$ or L$^2$) is absent. For example, in some embodiments each of L$^1$ and L$^2$ is a direct bond.

In other different embodiments of the foregoing, for at least one occurrence of R$^{1a}$ and R$^{1b}$, R$^{1a}$ is H or C$_1$-C$_{12}$ alkyl, and R$^{1b}$ together with the carbon atom to which it is bound is taken together with an adjacent R$^{1b}$ and the carbon atom to which it is bound to form a carbon-carbon double bond.

In still other different embodiments of structure (VI), for at least one occurrence of R$^{4a}$ and R$^{4b}$, R$^{4a}$ is H or C$_1$-C$_{12}$ alkyl, and R$^{4b}$ together with the carbon atom to which it is bound is taken together with an adjacent R$^{4b}$ and the carbon atom to which it is bound to form a carbon-carbon double bond.

In more embodiments of structure (VI), for at least one occurrence of R$^{2a}$ and R$^{2b}$, R$^{2a}$ is H or C$_1$-C$_{12}$ alkyl, and R$^{2b}$ together with the carbon atom to which it is bound is taken together with an adjacent R$^{2b}$ and the carbon atom to which it is bound to form a carbon-carbon double bond.

In other different embodiments of any of the foregoing, for at least one occurrence of R$^{3a}$ and R$^{3b}$, R$^{3a}$ is H or C$_1$-C$_{12}$ alkyl, and R$^{3b}$ together with the carbon atom to which it is bound is taken together with an adjacent R$^{3b}$ and the carbon atom to which it is bound to form a carbon-carbon double bond.

It is understood that "carbon-carbon" double bond refers to one of the following structures:

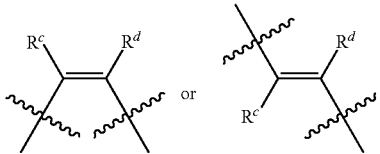

wherein R$^c$ and R$^d$ are, at each occurrence, independently H or a substituent. For example, in some embodiments R$^c$ and R$^d$ are, at each occurrence, independently H, C$_1$-C$_{12}$ alkyl or cycloalkyl, for example H or C$_1$-C$_{12}$ alkyl.

In various other embodiments, the compound has one of the following structures (VIC) or (VID):

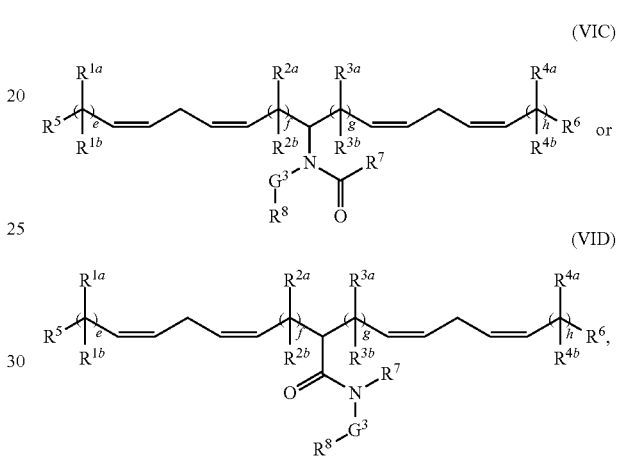
(VIC)

(VID)

wherein e, f, g and h are each independently an integer from 1 to 12.

In some embodiments, the compound has structure (VIC). In other embodiments, the compound has structure (VID).

In various embodiments of the compounds of structures (VIC) or (VID), e, f, g and h are each independently an integer from 4 to 10.

In other different embodiments,

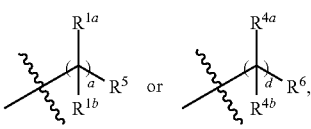

or both, independently has one of the following structures:

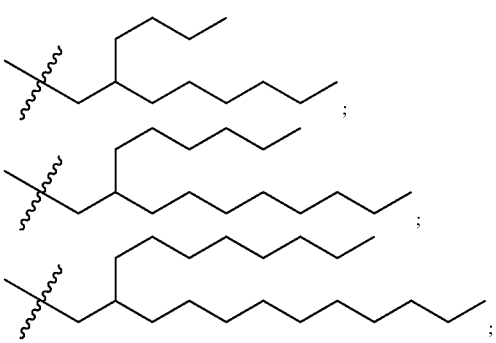

-continued

[chemical structures]; ; ; ; ; ; ; or .

In certain embodiments of the foregoing, a, b, c and d are each independently an integer from 2 to 12 or an integer from 4 to 12. In other embodiments, a, b, c and d are each independently an integer from 8 to 12 or 5 to 9. In some certain embodiments, a is 0. In some embodiments, a is 1. In other embodiments, a is 2. In more embodiments, a is 3. In yet other embodiments, a is 4. In some embodiments, a is 5. In other embodiments, a is 6. In more embodiments, a is 7. In yet other embodiments, a is 8. In some embodiments, a is 9. In other embodiments, a is 10. In more embodiments, a is 11. In yet other embodiments, a is 12. In some embodiments, a is 13. In other embodiments, a is 14. In more embodiments, a is 15. In yet other embodiments, a is 16.

In some embodiments of structure (VI), b is 1. In other embodiments, b is 2. In more embodiments, b is 3. In yet other embodiments, b is 4. In some embodiments, b is 5. In other embodiments, b is 6. In more embodiments, b is 7. In yet other embodiments, b is 8. In some embodiments, b is 9. In other embodiments, b is 10. In more embodiments, b is 11. In yet other embodiments, b is 12. In some embodiments, b is 13. In other embodiments, b is 14. In more embodiments, b is 15. In yet other embodiments, b is 16.

In some embodiments of structure (VI), c is 1. In other embodiments, c is 2. In more embodiments, c is 3. In yet other embodiments, c is 4. In some embodiments, c is 5. In other embodiments, c is 6. In more embodiments, c is 7. In yet other embodiments, c is 8. In some embodiments, c is 9. In other embodiments, c is 10. In more embodiments, c is 11. In yet other embodiments, c is 12. In some embodiments, c is 13. In other embodiments, c is 14. In more embodiments, c is 15. In yet other embodiments, c is 16.

In some certain embodiments of structure (VI), d is 0. In some embodiments, d is 1. In other embodiments, d is 2. In more embodiments, d is 3. In yet other embodiments, d is 4. In some embodiments, d is 5. In other embodiments, d is 6. In more embodiments, d is 7. In yet other embodiments, d is 8. In some embodiments, d is 9. In other embodiments, d is 10. In more embodiments, d is 11. In yet other embodiments, d is 12. In some embodiments, d is 13. In other embodiments, d is 14. In more embodiments, d is 15. In yet other embodiments, d is 16.

In some embodiments of structure (VI), e is 1. In other embodiments, e is 2. In more embodiments, e is 3. In yet other embodiments, e is 4. In some embodiments, e is 5. In other embodiments, e is 6. In more embodiments, e is 7. In yet other embodiments, e is 8. In some embodiments, e is 9. In other embodiments, e is 10. In more embodiments, e is 11. In yet other embodiments, e is 12.

In some embodiments of structure (VI), f is 1. In other embodiments, f is 2. In more embodiments, f is 3. In yet other embodiments, f is 4. In some embodiments, f is 5. In other embodiments, f is 6. In more embodiments, f is 7. In yet other embodiments, f is 8. In some embodiments, f is 9. In other embodiments, f is 10. In more embodiments, f is 11. In yet other embodiments, f is 12.

In some embodiments of structure (VI), g is 1. In other embodiments, g is 2. In more embodiments, g is 3. In yet other embodiments, g is 4. In some embodiments, g is 5. In other embodiments, g is 6. In more embodiments, g is 7. In yet other embodiments, g is 8. In some embodiments, g is 9. In other embodiments, g is 10. In more embodiments, g is 11. In yet other embodiments, g is 12.

In some embodiments of structure (VI), h is 1. In other embodiments, e is 2. In more embodiments, h is 3. In yet other embodiments, h is 4. In some embodiments, e is 5. In other embodiments, h is 6. In more embodiments, h is 7. In yet other embodiments, h is 8. In some embodiments, h is 9. In other embodiments, h is 10. In more embodiments, h is 11. In yet other embodiments, h is 12.

In some other various embodiments of structure (VI), a and d are the same. In some other embodiments, b and c are the same. In some other specific embodiments a and d are the same and b and c are the same.

The sum of a and b and the sum of c and d are factors which may be varied to obtain a lipid having the desired properties. In one embodiment, a and b are chosen such that their sum is an integer ranging from 14 to 24. In other embodiments, c and d are chosen such that their sum is an integer ranging from 14 to 24. In further embodiment, the sum of a and b and the sum of c and d are the same. For example, in some embodiments the sum of a and b and the sum of c and d are both the same integer which may range from 14 to 24. In still more embodiments, a. b, c and d are selected such that the sum of a and b and the sum of c and d is 12 or greater.

The substituents at $R^{1a}$, $R^{2a}$, $R^{3a}$ and $R^{4a}$ are not particularly limited. In some embodiments, at least one of $R^{1a}$, $R^{2a}$, $R^{3a}$ and $R^{4a}$ is H. In certain embodiments $R^{1a}$, $R^{2a}$, $R^{3a}$ and $R^{4a}$ are H at each occurrence. In certain other embodiments at least one of $R^{1a}$, $R^{2a}$, $R^{3a}$ and $R^{4a}$ is $C_1$-$C_{12}$ alkyl. In certain other embodiments at least one of $R^{1a}$, $R^{2a}$, $R^{3a}$ and $R^{4a}$ is $C_1$-$C_8$ alkyl. In certain other embodiments at least one of $R^{1a}$, $R^{2a}$, $R^{3a}$ and $R^{4a}$ is $C_1$-$C_6$ alkyl. In some of the foregoing embodiments, the $C_1$-$C_8$ alkyl is methyl, ethyl, n-propyl, iso-propyl, n-butyl, iso-butyl, tert-butyl, n-hexyl or n-octyl.

In certain embodiments of the foregoing, $R^{1a}$, $R^{1b}$, $R^{4a}$ and $R^{4b}$ are $C_1$-$C_{12}$ alkyl at each occurrence.

In further embodiments of the foregoing, at least one of $R^{1b}$, $R^{2b}$, $R^{3b}$ and $R^{4b}$ is H or $R^{1b}$, $R^{2b}$, $R^{3b}$ and $R^{4b}$ are H at each occurrence.

In certain embodiments of the foregoing, $R^{1b}$ together with the carbon atom to which it is bound is taken together with an adjacent $R^{1b}$ and the carbon atom to which it is bound to form a carbon-carbon double bond. In other embodiments of the foregoing $R^{4b}$ together with the carbon atom to which it is bound is taken together with an adjacent $R^{4b}$ and the carbon atom to which it is bound to form a carbon-carbon double bond.

The substituents at $R^5$ and $R^6$ are not particularly limited in the foregoing embodiments. In certain embodiments one of $R^5$ or $R^6$ is methyl. In other embodiments each of $R^5$ or $R^6$ is methyl.

The substituents at $R^7$ are not particularly limited in the foregoing embodiments. In certain embodiments $R^7$ is $C_6$-$C_{16}$ alkyl. In some other embodiments, $R^7$ is $C_6$-$C_9$ alkyl. In some of these embodiments, $R^7$ is substituted with —C(=O)R$^b$, —O(C=O)R$^b$, —C(=O)R$^b$, —OR$^b$, —S(O)$_x$R$^b$, —S—SR$^b$, —C(=O)SR$^b$, —SC(=O)R$^b$, —NR$^a$R$^b$, —NR$^a$C(=O)R$^b$, —C(=O)NR$^a$R$^b$, —NR$^a$C(=O)NR$^a$R$^b$, —OC(=O)NR$^a$R$^b$, —NR$^a$C(=O)OR$^b$, —NR$^a$S(O)$_x$NR$^a$R$^b$, —NR$^a$S(O)$_x$R$^b$ or —S(O)$_x$NR$^a$R$^b$, wherein: $R^a$ is H or $C_1$-$C_{12}$ alkyl; $R^b$ is $C_1$-$C_{15}$ alkyl; and x is 0, 1 or 2. For example, in some embodiments $R^7$ is substituted with —C(=O)OR or —O(C=O)R$^b$.

In various of the foregoing embodiments of structure (VI), $R^b$ is branched $C_3$-$C_{15}$ alkyl. For example, in some embodiments $R^b$ has one of the following structures:

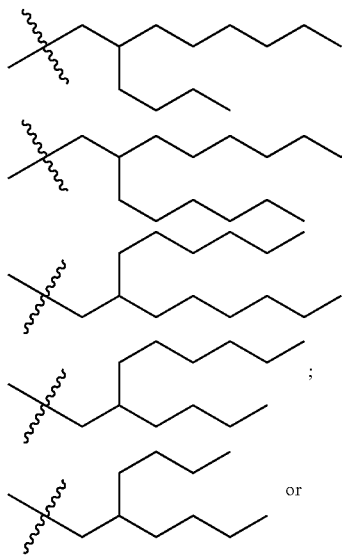

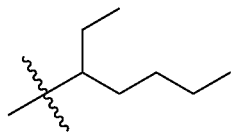

In certain embodiments, $R^8$ is OH.

In other embodiments of structure (VI), $R^8$ is —N(R$^9$)(C=O)R$^{10}$. In some other embodiments, $R^8$ is —(C=O)NR$^9$R$^{10}$. In still more embodiments, $R^8$ is —NR$^9$R$^{10}$. In some of the foregoing embodiments, $R^9$ and $R^{10}$ are each independently H or $C_1$-$C_8$ alkyl, for example H or $C_1$-$C_3$ alkyl. In more specific of these embodiments, the $C_1$-$C_8$ alkyl or $C_1$-$C_3$ alkyl is unsubstituted or substituted with hydroxyl. In other of these embodiments, $R^9$ and $R^{10}$ are each methyl.

In yet more embodiments of structure (VI), $R^8$ is —(C=O)OR$^{11}$. In some of these embodiments $R^{11}$ is benzyl.

In yet more specific embodiments of structure (VI), $R^8$ has one of the following structures:

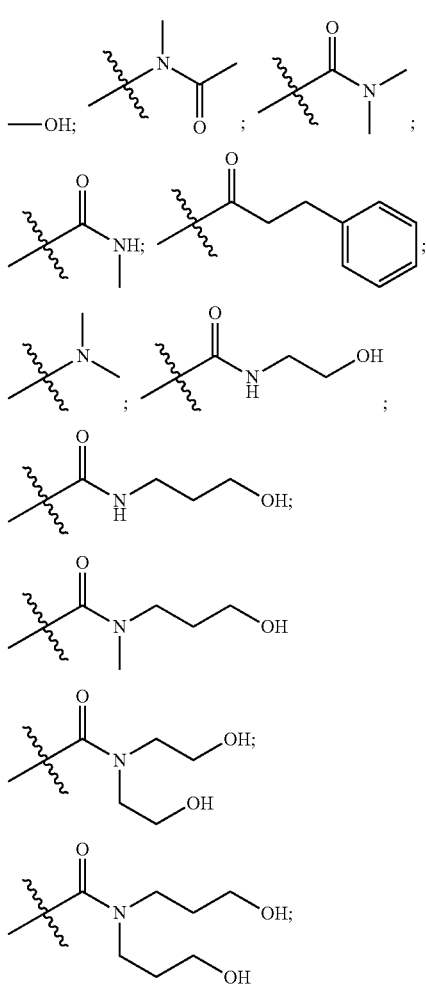

209

-continued

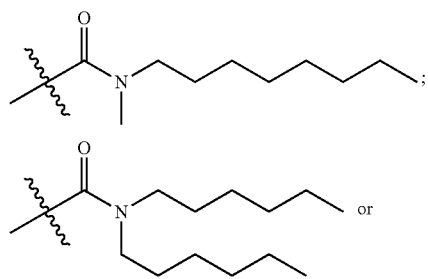

210

-continued

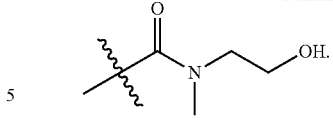

In still other embodiments of the foregoing compounds, $G^3$ is $C_2$-$C_5$ alkylene, for example $C_2$-$C_4$ alkylene, $C_3$ alkylene or $C_4$ alkylene. In some of these embodiments, $R^8$ is OH. In other embodiments, $G^2$ is absent and $R^7$ is $C_1$-$C_2$ alkylene, such as methyl.

In various different embodiments, the compound has one of the structures set forth in Table 5 below.

TABLE 5

Representative cationic lipids of structure (VI)

| No. | Structure |
|---|---|
| VI-1 | 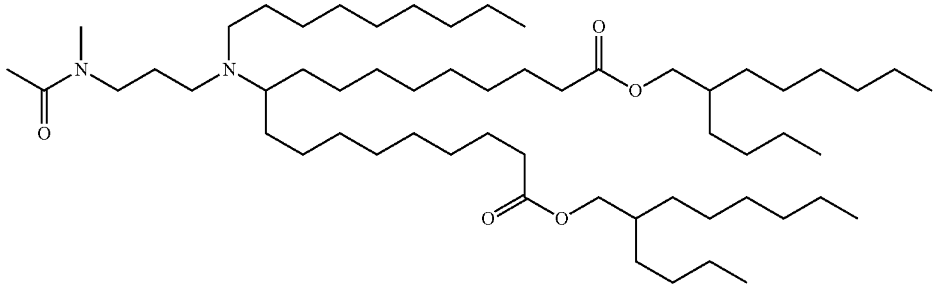 [SMILES: CCCCCCCCCN(CCCN(C)C(C)=O)C(CCCCCCCCC(=O)OCC(CCCC)CCCCCC)CCCCCCCCC(=O)OCC(CCCC)CCCCCC] |
| VI-2 | 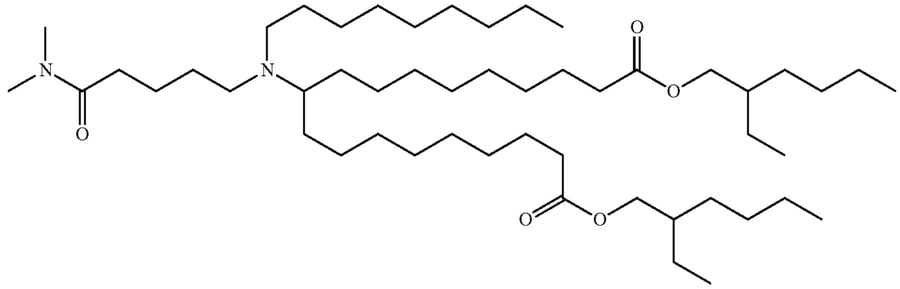 [SMILES: CCCCCCCCCN(CCCCC(=O)N(C)C)C(CCCCCCCCC(=O)OCC(CC)CCCC)CCCCCCCCC(=O)OCC(CC)CCCC] |
| VI-3 | 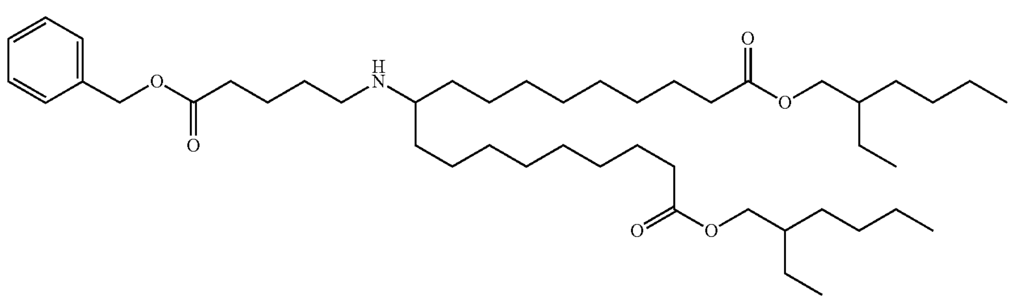 [SMILES: CCCCC(CC)COC(=O)CCCCCCCCC(CCCCCCCCC(=O)OCC(CC)CCCC)NCCCCC(=O)OCc1ccccc1] |

TABLE 5-continued

Representative cationic lipids of structure (VI)

| No. | Structure |
|---|---|
| VI-4 | 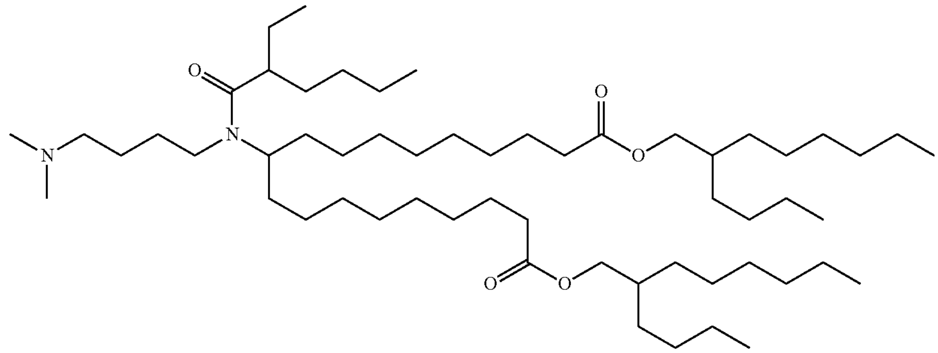 [SMILES: CCCCCCC(CCCC)COC(=O)CCCCCCCCC(CCCCCCCCC(=O)OCC(CCCC)CCCCCC)N(CCCCN(C)C)C(=O)C(CC)CCCC] |
| VI-5 | 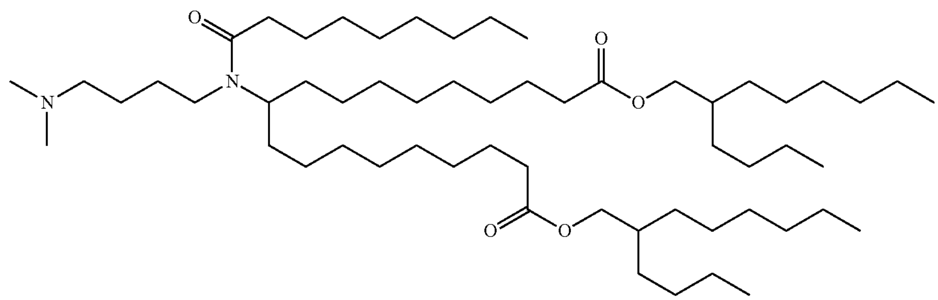 [SMILES: CCCCCCCCC(=O)N(CCCCN(C)C)C(CCCCCCCCC(=O)OCC(CCCC)CCCCCC)CCCCCCCCC(=O)OCC(CCCC)CCCCCC] |
| VI-6 | 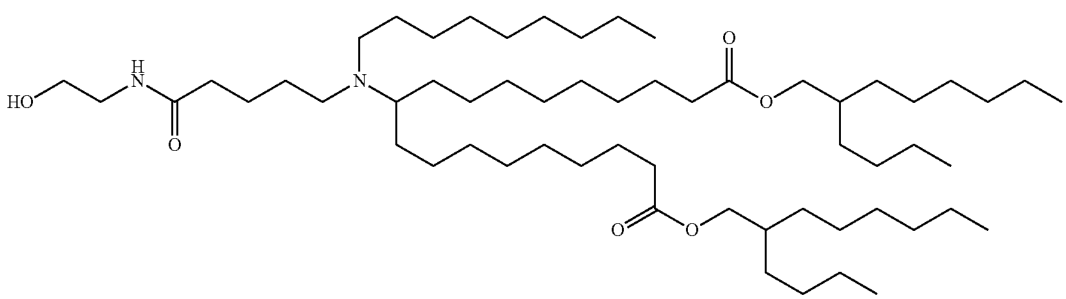 [SMILES: CCCCCCCCCN(CCCCC(=O)NCCO)C(CCCCCCCCC(=O)OCC(CCCC)CCCCCC)CCCCCCCCC(=O)OCC(CCCC)CCCCCC] |
| VI-7 | 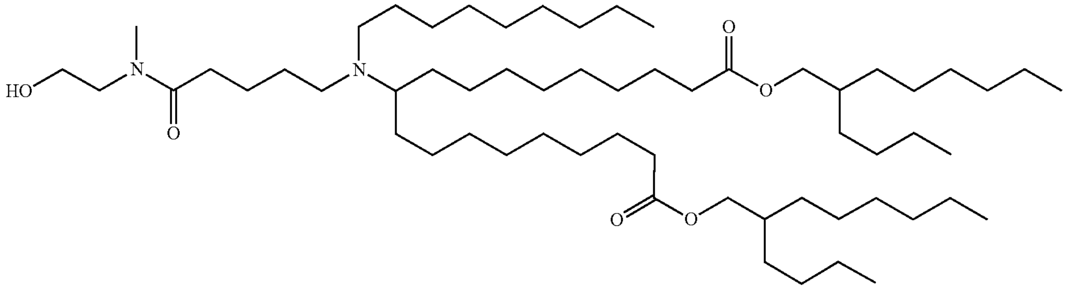 [SMILES: CCCCCCCCCN(CCCCC(=O)N(C)CCO)C(CCCCCCCCC(=O)OCC(CCCC)CCCCCC)CCCCCCCCC(=O)OCC(CCCC)CCCCCC] |
| VI-8 | 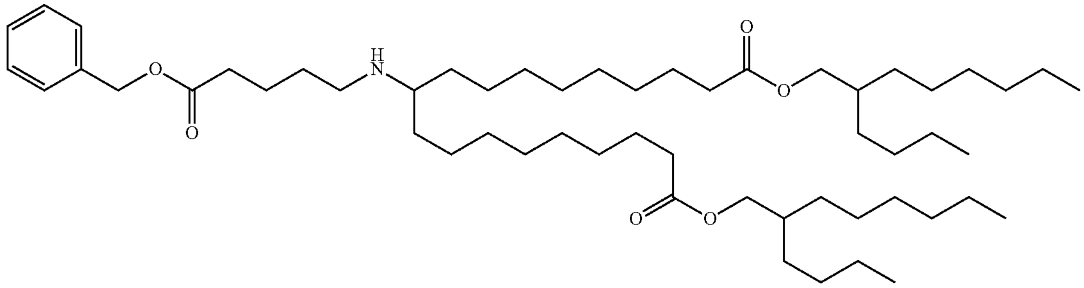 [SMILES: CCCCCCC(CCCC)COC(=O)CCCCCCCCC(CCCCCCCCC(=O)OCC(CCCC)CCCCCC)NCCCCC(=O)OCc1ccccc1] |

TABLE 5-continued

Representative cationic lipids of structure (VI)

| No. | Structure |
|---|---|
| VI-9 | 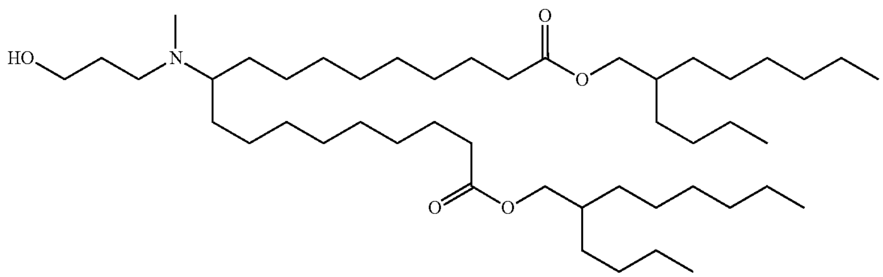 [SMILES: CCCCCCC(CCCC)COC(=O)CCCCCCCCC(CCCCCCCCC(=O)OCC(CCCC)CCCCCC)N(C)CCCO] |
| VI-10 | 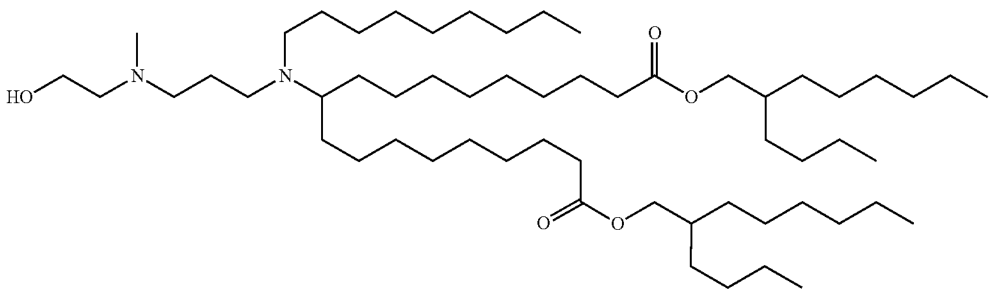 [SMILES: CCCCCCCCCN(CCCN(C)CCO)C(CCCCCCCCCC(=O)OCC(CCCC)CCCCCC)CCCCCCCCC(=O)OCC(CCCC)CCCCCC] |
| VI-11 | 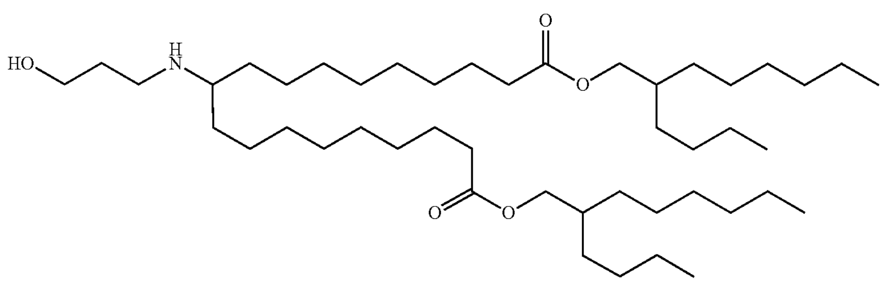 [SMILES: CCCCCCC(CCCC)COC(=O)CCCCCCCCC(CCCCCCCCC(=O)OCC(CCCC)CCCCCC)NCCCO] |
| VI-12 | 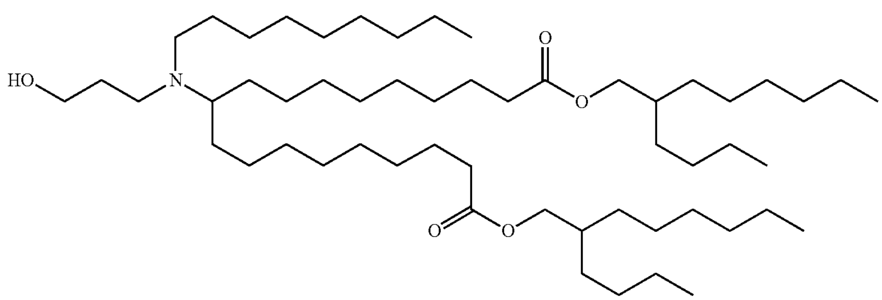 [SMILES: CCCCCCCCCN(CCCO)C(CCCCCCCCC(=O)OCC(CCCC)CCCCCC)CCCCCCCCC(=O)OCC(CCCC)CCCCCC] |
| VI-13 | 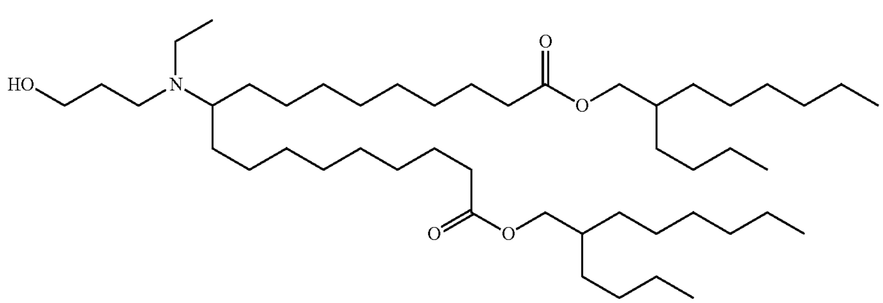 [SMILES: CCCCCCC(CCCC)COC(=O)CCCCCCCCC(CCCCCCCCC(=O)OCC(CCCC)CCCCCC)N(CC)CCCO] |

TABLE 5-continued

Representative cationic lipids of structure (VI)

| No. | Structure |
|---|---|
| VI-14 | 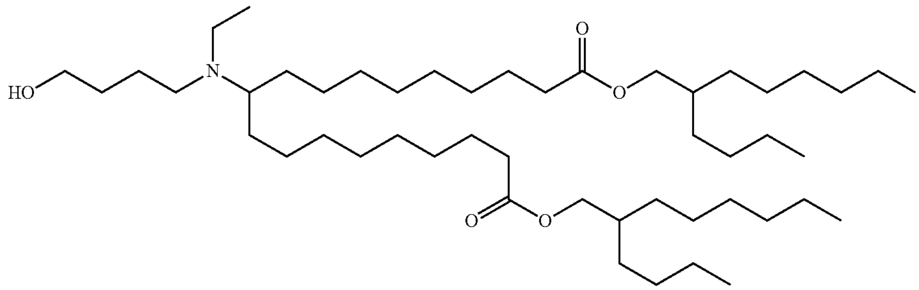 [SMILES: CCCCCCC(CCCC)COC(=O)CCCCCCCCC(CCCCCCCCC(=O)OCC(CCCC)CCCCCC)N(CC)CCCCO] |
| VI-15 | 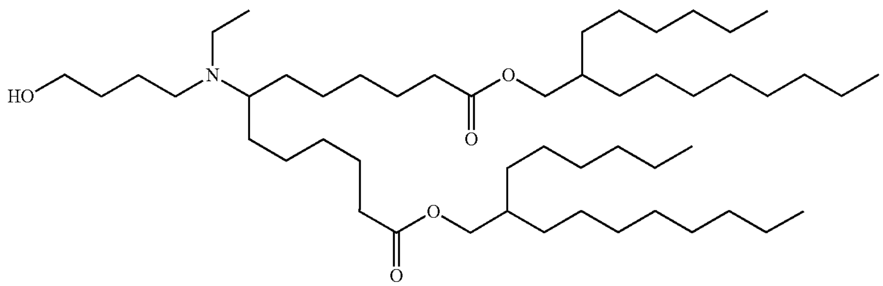 [SMILES: CCCCCCCCC(CCCCCC)COC(=O)CCCCCCC(CCCCCC(=O)OCC(CCCCCC)CCCCCCCC)N(CC)CCCCO] |
| VI-16 | 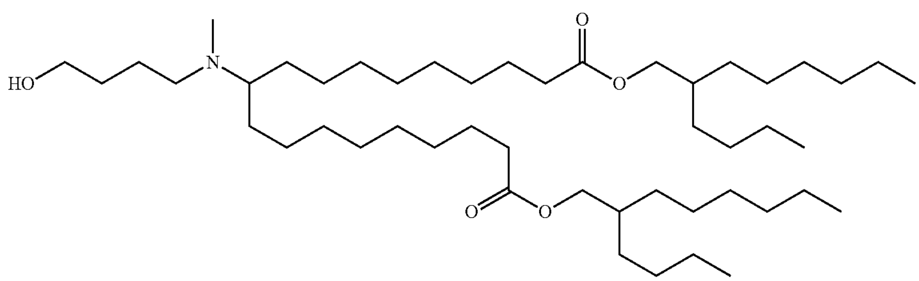 [SMILES: CCCCCCC(CCCC)COC(=O)CCCCCCCCC(CCCCCCCCC(=O)OCC(CCCC)CCCCCC)N(C)CCCCO] |
| VI-17 | 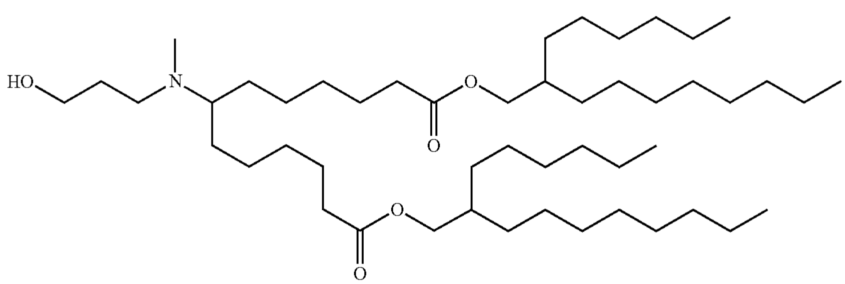 [SMILES: CCCCCCCCC(CCCCCC)COC(=O)CCCCCC(CCCCCC(=O)OCC(CCCCCC)CCCCCCCC)N(C)CCCO] |
| VI-18 | 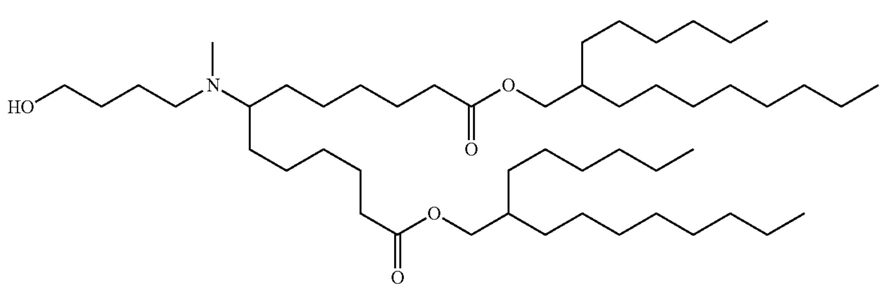 [SMILES: CCCCCCCCC(CCCCCC)COC(=O)CCCCCC(CCCCCC(=O)OCC(CCCCCC)CCCCCCCC)N(C)CCCCO] |

TABLE 5-continued

Representative cationic lipids of structure (VI)

| No. | Structure |
|---|---|
| VI-19 | 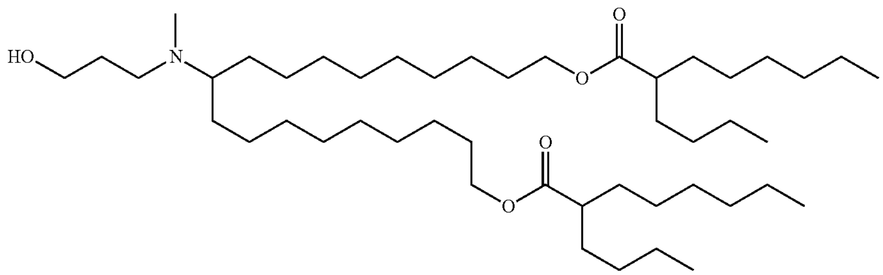 [SMILES: CCCCCCC(CCCC)C(=O)OCCCCCCCCCC(CCCCCCCCCOC(=O)C(CCCC)CCCCCC)N(C)CCCO] |
| VI-20 | 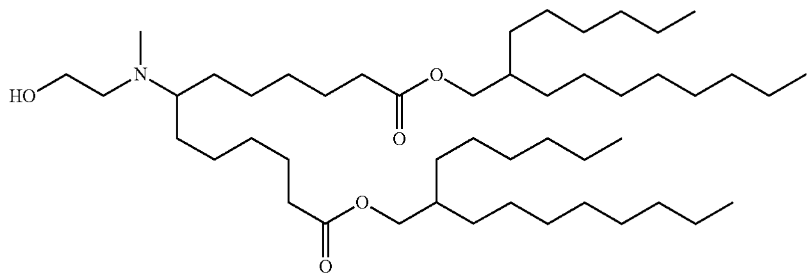 [SMILES: CCCCCCCCC(CCCCCC)COC(=O)CCCCCC(CCCCCC(=O)OCC(CCCCCC)CCCCCCCC)N(C)CCO] |
| VI-21 | 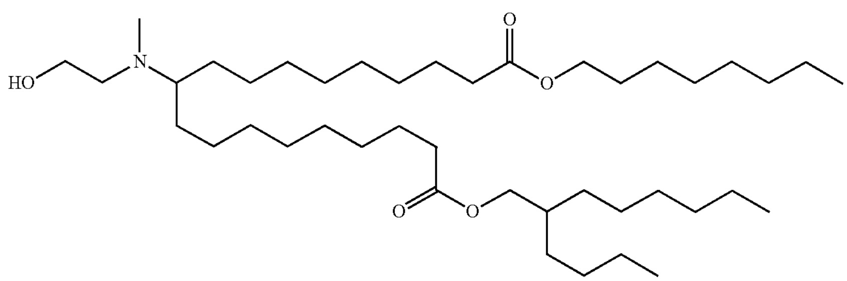 [SMILES: CCCCCCCCOC(=O)CCCCCCCCC(CCCCCCCCC(=O)OCC(CCCC)CCCCCC)N(C)CCO] |
| VI-22 | 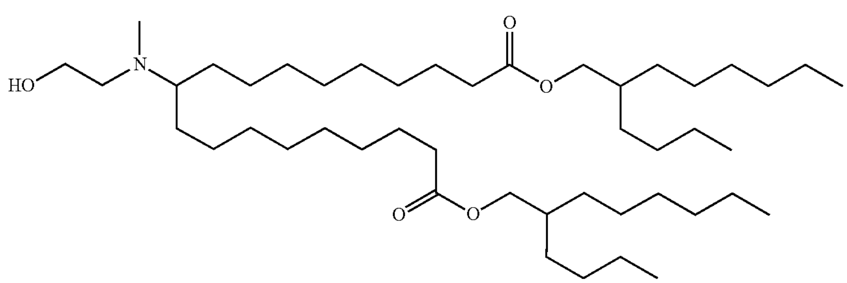 [SMILES: CCCCCCC(CCCC)COC(=O)CCCCCCCCC(CCCCCCCCC(=O)OCC(CCCC)CCCCCC)N(C)CCO] |
| VI-23 | 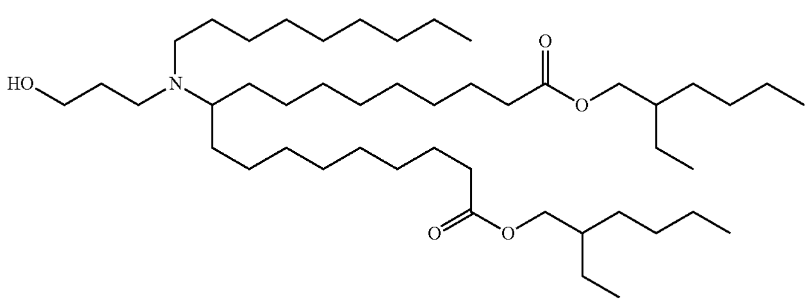 [SMILES: CCCCCCCCCN(CCCO)C(CCCCCCCCC(=O)OCC(CC)CCCC)CCCCCCCCC(=O)OCC(CC)CCCC] |

TABLE 5-continued

Representative cationic lipids of structure (VI)

| No. | Structure |
|---|---|
| VI-24 | 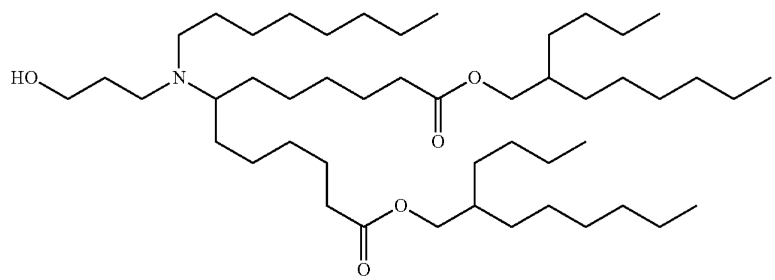 [SMILES: CCCCCCCCN(CCCO)C(CCCCCC(=O)OCC(CCCC)CCCCCC)CCCCCC(=O)OCC(CCCC)CCCCCC] |
| VI-25 | 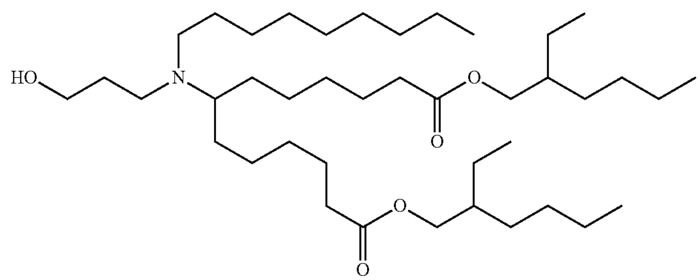 [SMILES: CCCCCCCCCN(CCCO)C(CCCCCC(=O)OCC(CC)CCCC)CCCCCC(=O)OCC(CC)CCCC] |
| VI-26 | 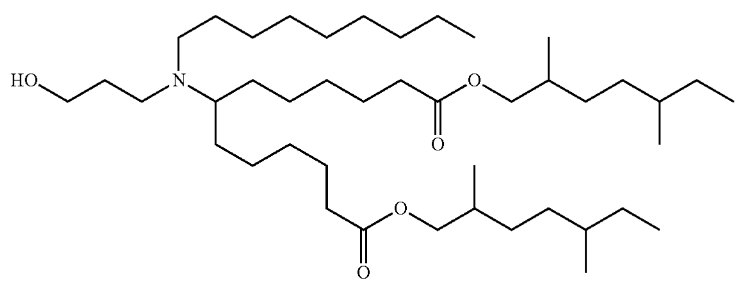 [SMILES: CCCCCCCCCN(CCCO)C(CCCCCC(=O)OCC(C)CCC(C)CC)CCCCCC(=O)OCC(C)CCC(C)CC] |
| VI-27 | 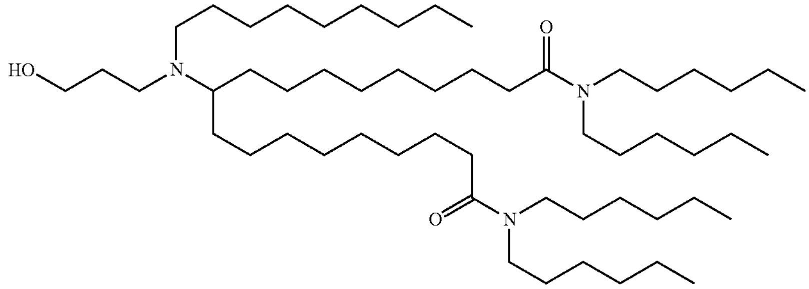 [SMILES: CCCCCCCCCN(CCCO)C(CCCCCCCCC(=O)N(CCCCCC)CCCCCC)CCCCCCCCC(=O)N(CCCCCC)CCCCCC] |
| VI-28 | 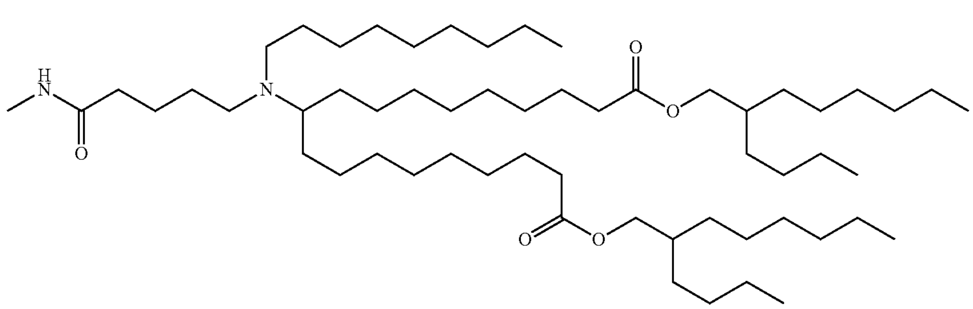 [SMILES: CCCCCCCCCN(CCCCC(=O)NC)C(CCCCCCCCC(=O)OCC(CCCC)CCCCCC)CCCCCCCCC(=O)OCC(CCCC)CCCCCC] |

TABLE 5-continued

Representative cationic lipids of structure (VI)

| No. | Structure |
|---|---|
| VI-29 | 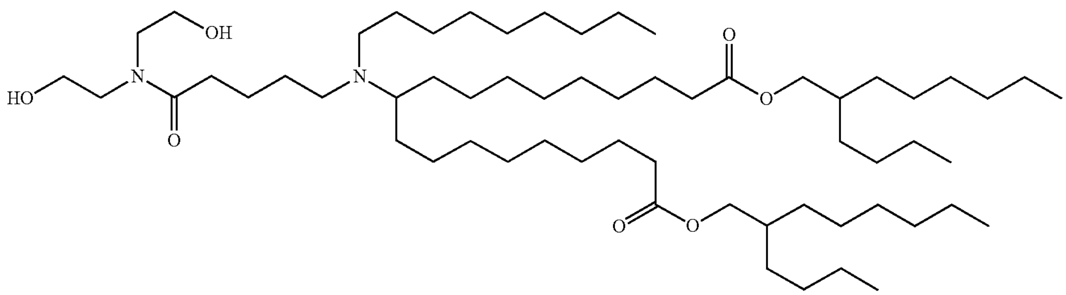 [SMILES: CCCCCCCCCN(CCCCC(=O)N(CCO)CCO)C(CCCCCCCCC(=O)OCC(CCCC)CCCCCC)CCCCCCCCC(=O)OCC(CCCC)CCCCCC] |
| VI-30 | 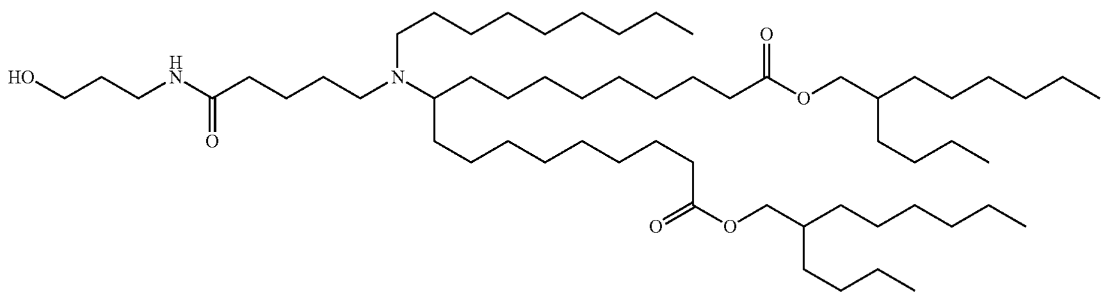 [SMILES: CCCCCCCCCN(CCCCC(=O)NCCCO)C(CCCCCCCCC(=O)OCC(CCCC)CCCCCC)CCCCCCCCC(=O)OCC(CCCC)CCCCCC] |
| VI-31 | 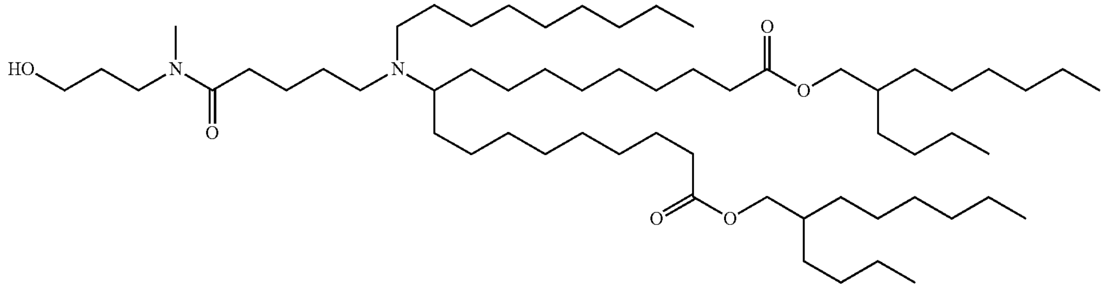 [SMILES: CCCCCCCCCN(CCCCC(=O)N(C)CCCO)C(CCCCCCCCC(=O)OCC(CCCC)CCCCCC)CCCCCCCCC(=O)OCC(CCCC)CCCCCC] |
| VI-32 | 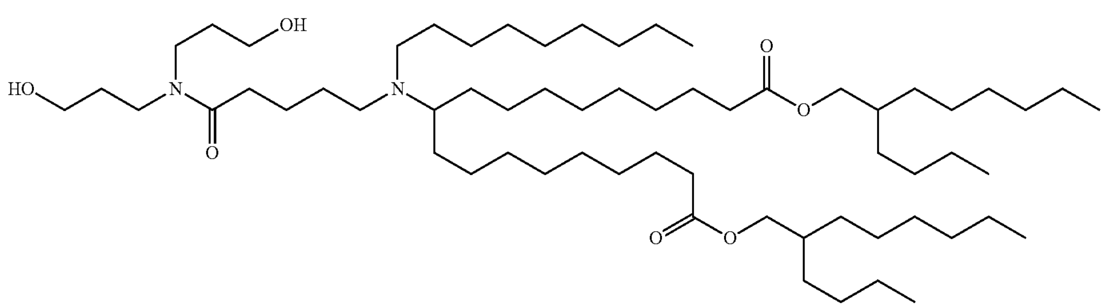 [SMILES: CCCCCCCCCN(CCCCC(=O)N(CCCO)CCCO)C(CCCCCCCCC(=O)OCC(CCCC)CCCCCC)CCCCCCCCC(=O)OCC(CCCC)CCCCCC] |
| VI-33 | 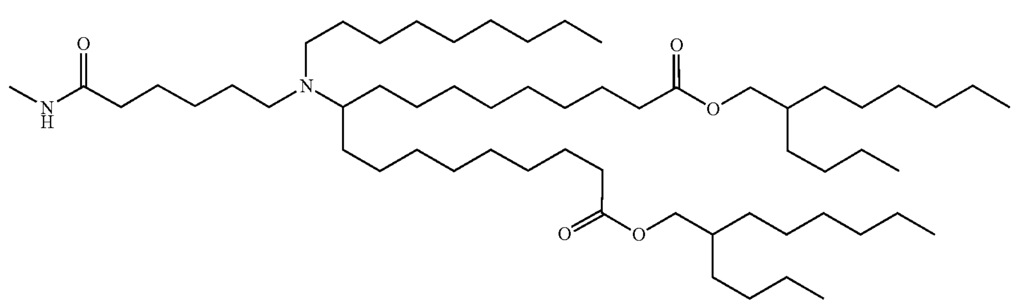 [SMILES: CCCCCCCCCN(CCCCCC(=O)NC)C(CCCCCCCCC(=O)OCC(CCCC)CCCCCC)CCCCCCCCC(=O)OCC(CCCC)CCCCCC] |

TABLE 5-continued

Representative cationic lipids of structure (VI)

| No. | Structure |
|---|---|
| VI-34 | 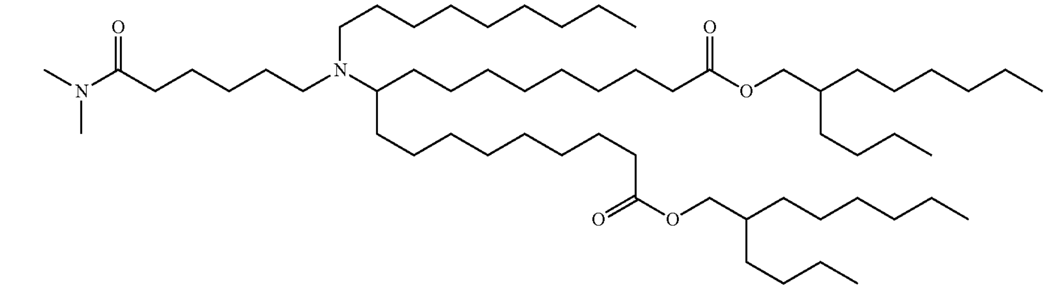 [SMILES: CCCCCCCCCN(CCCCCC(=O)N(C)C)C(CCCCCCCCC(=O)OCC(CCCC)CCCCCC)CCCCCCCCC(=O)OCC(CCCC)CCCCCC] |
| VI-35 | 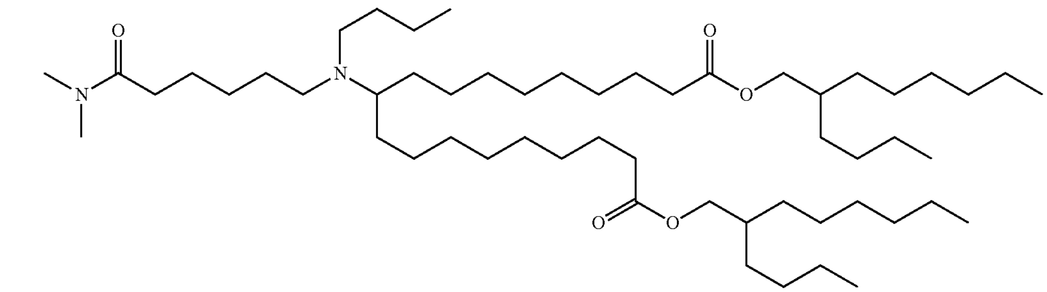 [SMILES: CCCCCCC(CCCC)COC(=O)CCCCCCCCC(CCCCCCCCC(=O)OCC(CCCC)CCCCCC)N(CCCC)CCCCCC(=O)N(C)C] |
| VI-36 | 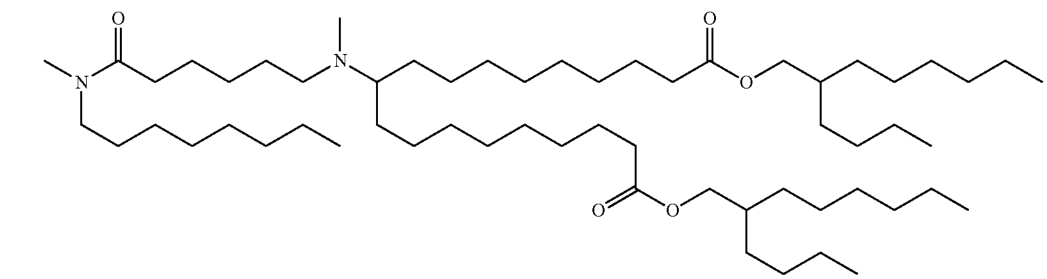 [SMILES: CCCCCCCCN(C)C(=O)CCCCCN(C)C(CCCCCCCCC(=O)OCC(CCCC)CCCCCC)CCCCCCCCC(=O)OCC(CCCC)CCCCCC] |
| VI-37 | 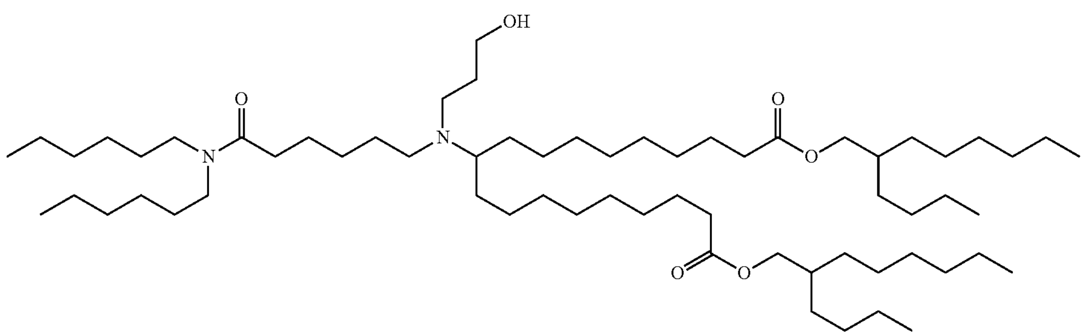 [SMILES: CCCCCCC(CCCC)COC(=O)CCCCCCCCC(CCCCCCCCC(=O)OCC(CCCC)CCCCCC)N(CCCO)CCCCCC(=O)N(CCCCCC)CCCCCC] |

In one embodiment, the cationic lipid is a compound having the following structure (VII):

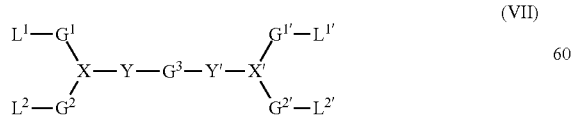

or a pharmaceutically acceptable salt, prodrug or stereoisomer thereof, wherein:

X and X' are each independently N or CR;

Y and Y' are each independently absent, —O(C═O)—, —(C═O)O— or NR, provided that:
a) Y is absent when X is N;
b) Y' is absent when X' is N;
c) Y is —O(C═O)—, —(C═O)O— or NR when X is CR; and
d) Y is —O(C═O)—, —(C═O)O— or NR when X is CR, $L^1$ and $L^{1'}$ are each independently —O(C═O)$R^1$, —(C═O)O$R^1$, —C(═O)$R^1$, —O$R^1$, —S(O)$_z$$R^1$, —S—S$R^1$, —C(═O)S$R^1$, —SC(═O)$R^1$, —NR$^a$C(═O)$R^1$, —C(═O)NR$^b$R$^c$, —NR$^a$C(═O)NR$^b$R$^c$, —OC(═O)NR$^b$R$^c$ or —NR$^a$C(═O)O$R^1$;

$L^2$ and $L^{2'}$ are each independently —O(C=O)R², —(C=O)OR², —C(=O)R², —OR², —S(O)$_z$R², —S—SR², —C(=O)SR², —SC(=O)R², —NR$^d$C(=O)R², —C(=O)NR$^e$R$^f$, —NR$^d$C(=O)NR$^e$R$^f$, —OC(=O)NR$^e$R$^f$; —NR$^d$C(=O)OR² or a direct bond to R²;

$G^1$, $G^{1'}$, $G^2$ and $G^{2'}$ are each independently $C_2$-$C_{12}$ alkylene or $C_2$-$C_{12}$ alkenylene;

$G^3$ is $C_2$-$C_{24}$ heteroalkylene or $C_2$-$C_{24}$ heteroalkenylene;

$R^a$, $R^b$, $R^d$ and $R^e$ are, at each occurrence, independently H, $C_1$-$C_{12}$ alkyl or $C_2$-$C_{12}$ alkenyl;

$R^c$ and $R^f$ are, at each occurrence, independently $C_1$-$C_{12}$ alkyl or $C_2$-$C_{12}$ alkenyl;

R is, at each occurrence, independently H or $C_1$-$C_{12}$ alkyl;

$R^1$ and $R^2$ are, at each occurrence, independently branched $C_6$-$C_{24}$ alkyl or branched $C_6$-$C_{24}$ alkenyl;

z is 0, 1 or 2, and wherein each alkyl, alkenyl, alkylene, alkenylene, heteroalkylene and heteroalkenylene is independently substituted or unsubstituted unless otherwise specified.

In other different embodiments of structure (VII):

X and X' are each independently N or CR;

Y and Y' are each independently absent or NR, provided that:
a) Y is absent when X is N;
b) Y' is absent when X' is N;
c) Y is NR when X is CR; and
d) Y' is NR when X' is CR, $L^1$ and $L^{1'}$ are each independently —O(C=O)R¹, —(C=O)OR¹, —C(=O)R¹, —OR¹, —S(O)$_z$R¹, —S—SR¹, —C(=O)SR¹, —SC(=O)R¹, —NR$^a$C(=O)R¹, —C(=O)NR$^b$R$^c$, —NR$^a$C(=O)NR$^b$R$^c$, —OC(=O)NR$^b$R$^c$ or —NR$^a$C(=O)OR¹;

$L^2$ and $L^{2'}$ are each independently —O(C=O)R², —(C=O)OR², —C(=O)R², —OR², —S(O)$_z$R², —S—SR², —C(=O)SR², —SC(=O)R², —NR$^d$C(=O)R², —C(=O)NR$^e$R$^f$, —NR$^d$C(=O)NR$^e$R$^f$, —OC(=O)NR$^e$R$^f$; —NR$^d$C(=O)OR² or a direct bond to R²;

$G^1$, $G^{1'}$, $G^2$ and $G^{2'}$ are each independently $C_2$-$C_{12}$ alkylene or $C_2$-$C_{12}$ alkenylene;

$G^3$ is $C_2$-$C_{24}$ alkyleneoxide or $C_2$-$C_{24}$ alkenyleneoxide;

$R^a$, $R^b$, $R^d$ and $R^e$ are, at each occurrence, independently H, $C_1$-$C_{12}$ alkyl or $C_2$-$C_{12}$ alkenyl;

$R^c$ and $R^f$ are, at each occurrence, independently $C_1$-$C_{12}$ alkyl or $C_2$-$C_{12}$ alkenyl;

R is, at each occurrence, independently H or $C_1$-$C_{12}$ alkyl;

$R^1$ and $R^2$ are, at each occurrence, independently branched $C_6$-$C_{24}$ alkyl or branched $C_6$-$C_{24}$ alkenyl;

z is 0, 1 or 2, and wherein each alkyl, alkenyl, alkylene, alkenylene, alkyleneoxide and alkenyleneoxide is independently substituted or unsubstituted unless otherwise specified.

In some embodiments of structure (VII), $G^3$ is $C_2$-$C_{24}$ alkyleneoxide or $C_2$-$C_{24}$ alkenyleneoxide. In certain embodiments, $G^3$ is unsubstituted. In other embodiments, $G^3$ is substituted, for example substituted with hydroxyl. In more specific embodiments $G^3$ is $C_2$-$C_{12}$ alkyleneoxide, for example, in some embodiments $G^3$ is $C_3$-$C_7$ alkyleneoxide or in other embodiments $G^3$ is $C_3$-$C_{12}$ alkyleneoxide.

In other embodiments of structure (VII), $G^3$ is $C_2$-$C_{24}$ alkyleneaminyl or $C_2$-$C_{24}$ alkenyleneaminyl, for example $C_6$-$C_{12}$ alkyleneaminyl. In some of these embodiments, $G^3$ is unsubstituted. In other of these embodiments, $G^3$ is substituted with $C_1$-$C_6$ alkyl.

In some embodiments of structure (VII), X and X' are each N, and Y and Y are each absent. In other embodiments, X and X' are each CR, and Y and Y' are each NR. In some of these embodiments, R is H.

In certain embodiments of structure (VII), X and X' are each CR, and Y and Y' are each independently —O(C=O)— or —(C=O)O—.

In some of the foregoing embodiments of structure (VII), the compound has one of the following structures (VIIA), (VIIB), (VIIC), (VIID), (VIIE), (VIIF), (VIIG) or (VIIH):

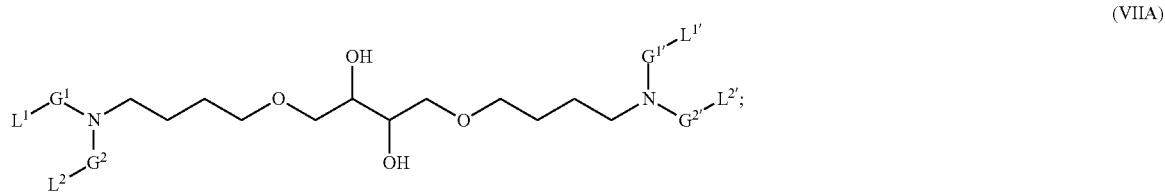

(VIIA)

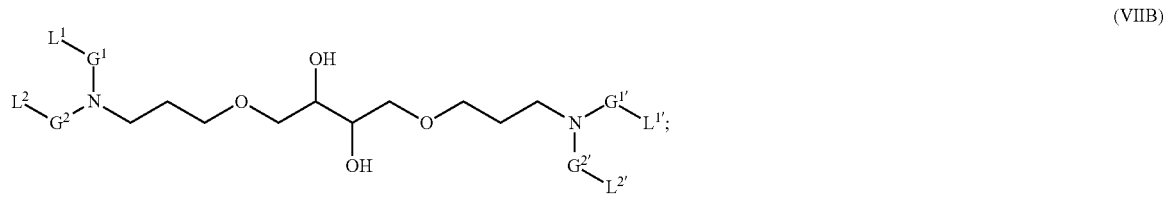

(VIIB)

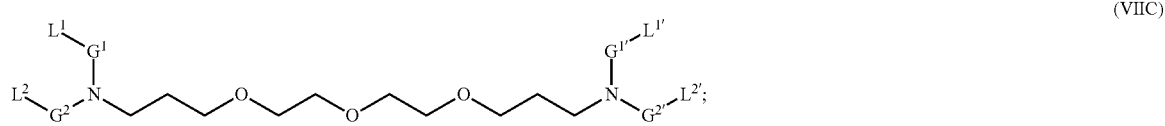

(VIIC)

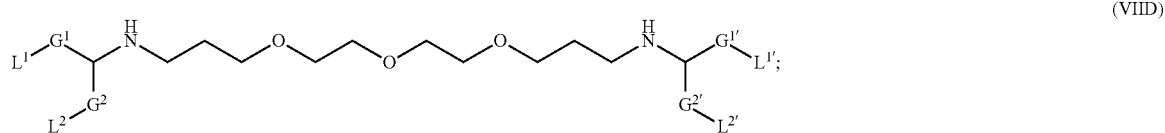

(VIID)

-continued

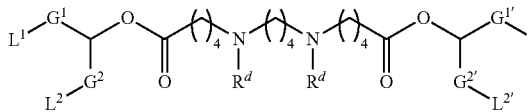 (VIIE)

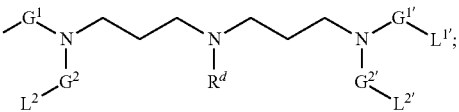 (VIIF)

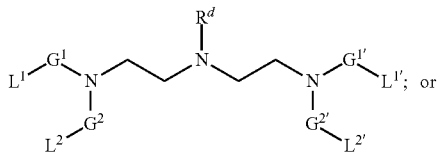 (VIIG)

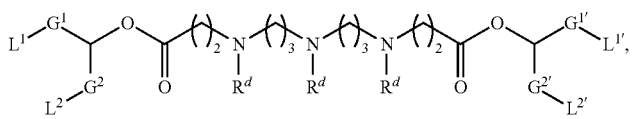 (VIIH)

wherein $R^d$ is, at each occurrence, independently H or optionally substituted $C_1$-$C_6$ alkyl. For example, in some embodiments $R^d$ is H. In other embodiments, $R^d$ is $C_1$-$C_6$ alkyl, such as methyl. In other embodiments, $R^d$ is substituted $C_1$-$C_6$ alkyl, such as $C_1$-$C_6$ alkyl substituted with —O(C=O)R, —(C=O)OR, —NRC(=O)R or —C(=O)N(R)$_2$, wherein R is, at each occurrence, independently H or $C_1$-$C_{12}$ alkyl.

In some of the foregoing embodiments of structure (VII), $L^1$ and $L^{1'}$ are each independently —O(C=O)$R^1$, —(C=O)$OR^1$ or —C(=O)$NR^bR^c$, and $L^2$ and $L^{2'}$ are each independently —O(C=O)$R^2$, —(C=O)$OR^2$ or —C(=O)$NR^eR^f$. For example, in some embodiments $L^1$ and $L^{1'}$ are each —(C=O)$OR^1$, and $L^2$ and $L^{2'}$ are each —(C=O)$OR^2$. In other embodiments $L^1$ and $L^{1'}$ are each —(C=O)$OR^1$, and $L^2$ and $L^{2'}$ are each —C(=O)$NR^eR^f$. In other embodiments $L^1$ and $L^{1'}$ are each —C(=O)$NR^bR^c$, and $L^2$ and $L^{2'}$ are each —C(=O)$NR^eR^f$.

In some embodiments of the foregoing, $G^1$, $G^{1'}$, $G^2$ and $G^{2'}$ are each independently $C_2$-$C_8$ alkylene, for example $C_4$-$C_8$ alkylene.

In some of the foregoing embodiments of structure (VII), $R^1$ or $R^2$, are each, at each occurrence, independently branched $C_6$-$C_{24}$ alkyl. For example, in some embodiments, $R^1$ and $R^2$ at each occurrence, independently have the following structure:

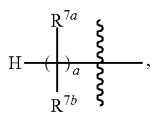

wherein:
$R^{7a}$ and $R^{7b}$ are, at each occurrence, independently H or $C_1$-$C_{12}$ alkyl; and
a is an integer from 2 to 12,
wherein $R^{7a}$, $R^{7b}$ and a are each selected such that $R^1$ and $R^2$ each independently comprise from 6 to 20 carbon atoms. For example, in some embodiments a is an integer ranging from 5 to 9 or from 8 to 12.

In some of the foregoing embodiments of structure (VII), at least one occurrence of $R^{7a}$ is H. For example, in some embodiments, $R^{7a}$ is H at each occurrence. In other different embodiments of the foregoing, at least one occurrence of $R^{7b}$ is $C_1$-$C_8$ alkyl. For example, in some embodiments, $C_1$-$C_8$ alkyl is methyl, ethyl, n-propyl, iso-propyl, n-butyl, iso-butyl, tert-butyl, n-hexyl or n-octyl.

In different embodiments of structure (VII), $R^1$ or $R^2$, or both, at each occurrence independently has one of the following structures:

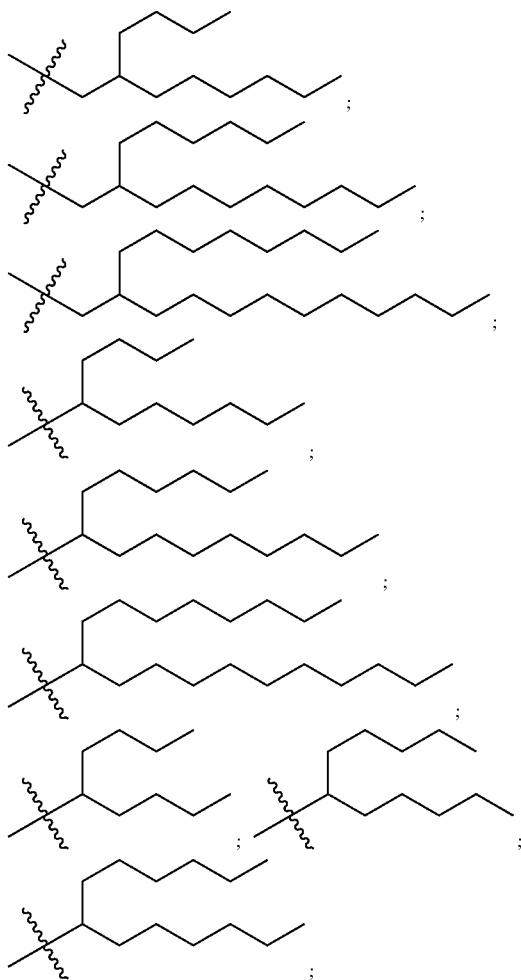

-continued

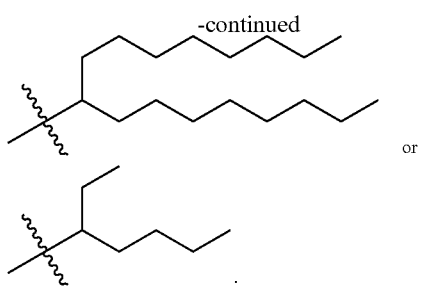

or

In some of the foregoing embodiments of structure (VII), $R^b$, $R^c$, $R^e$ and $R^f$, when present, are each independently $C_3$-$C_{12}$ alkyl. For example, in some embodiments $R^b$, $R^c$, $R^e$ and $R^f$, when present, are n-hexyl and in other embodiments $R^b$, $R^c$, $R^e$ and $R^f$, when present, are n-octyl.

In various different embodiments of structure (VII), the cationic lipid has one of the structures set forth in Table 6 below.

TABLE 6

Representative cationic lipids of structure (VII)

| No. | Structure |
|---|---|
| VII-1 | 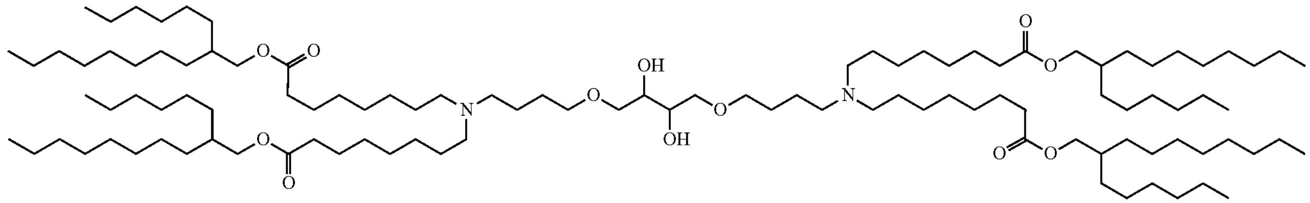 [SMILES: CCCCCCCCC(CCCCCC)COC(=O)CCCCCCCN(CCCCCCCC(=O)OCC(CCCCCC)CCCCCCCC)CCCCOCC(O)C(O)COCCCCN(CCCCCCCC(=O)OCC(CCCCCC)CCCCCCCC)CCCCCCCC(=O)OCC(CCCCCC)CCCCCCCC] |
| VII-2 | 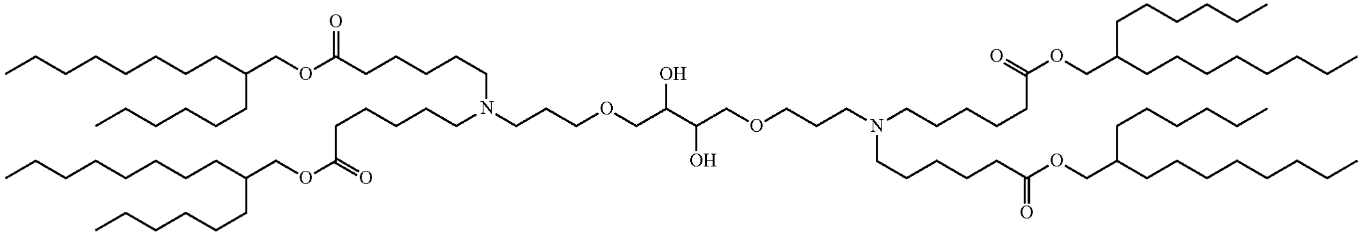 [SMILES: CCCCCCCCC(CCCCCC)COC(=O)CCCCCN(CCCCCC(=O)OCC(CCCCCC)CCCCCCCC)CCCOCC(O)C(O)COCCCN(CCCCCC(=O)OCC(CCCCCC)CCCCCCCC)CCCCCC(=O)OCC(CCCCCC)CCCCCCCC] |
| VII-3 | 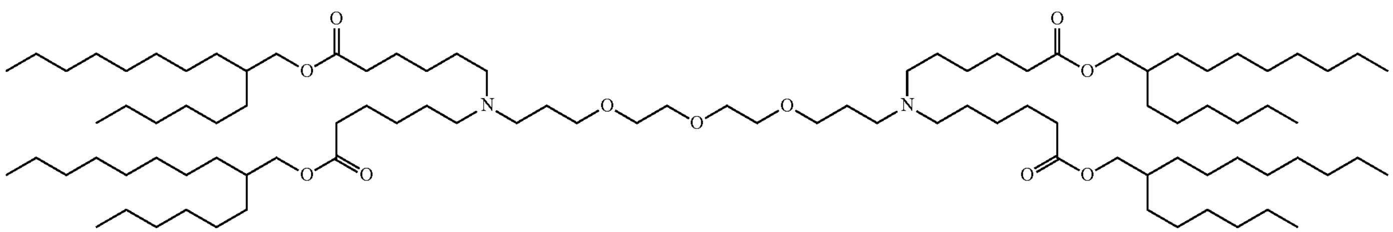 [SMILES: CCCCCCCCC(CCCCCC)COC(=O)CCCCCN(CCCCCC(=O)OCC(CCCCCC)CCCCCCCC)CCCOCCOCCOCCCN(CCCCCC(=O)OCC(CCCCCC)CCCCCCCC)CCCCCC(=O)OCC(CCCCCC)CCCCCCCC] |
| VII-4 | 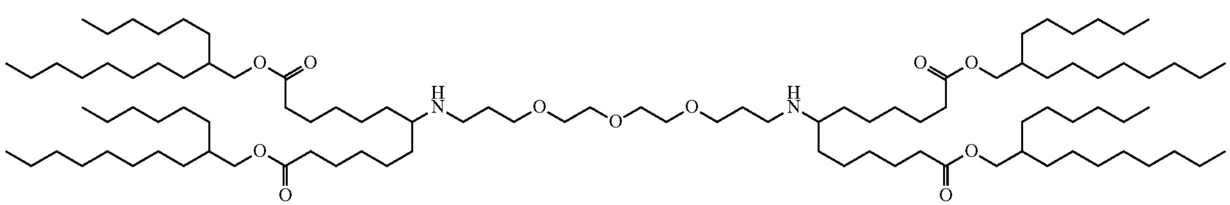 [SMILES: CCCCCCCCC(CCCCCC)COC(=O)CCCCCC(CCCCCC(=O)OCC(CCCCCC)CCCCCCCC)NCCCOCCOCCOCCCNC(CCCCCC(=O)OCC(CCCCCC)CCCCCCCC)CCCCCC(=O)OCC(CCCCCC)CCCCCCCC] |

TABLE 6-continued
Representative cationic lipids of structure (VII)
| No. | Structure |
|---|---|
| VII-5 | 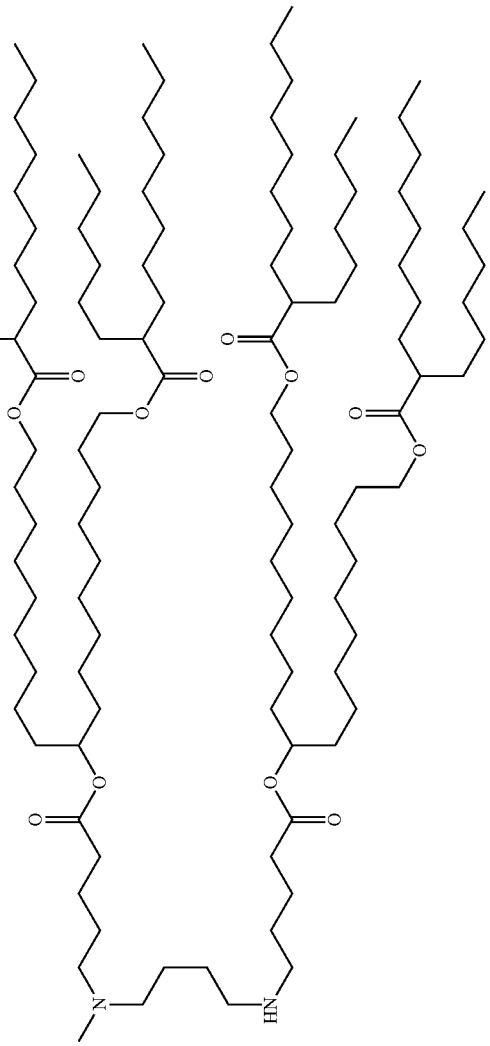 |
| VII-6 | 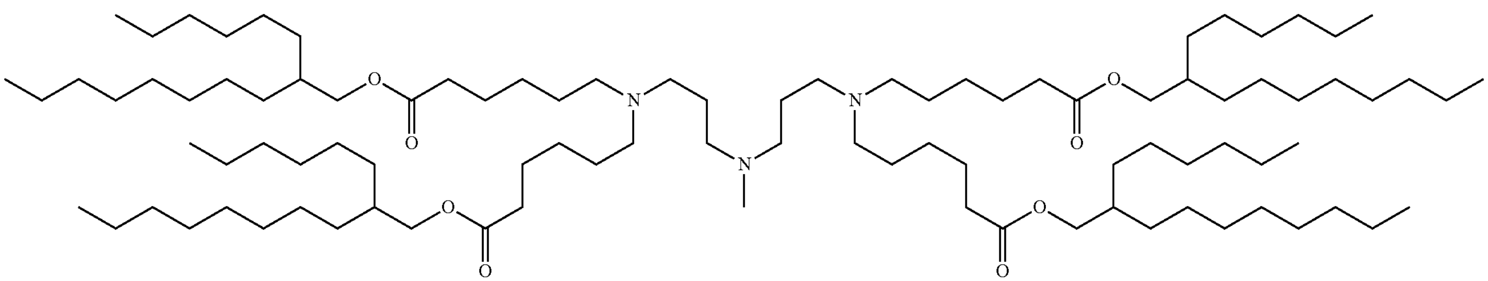 [SMILES: CCCCCCCCC(CCCCCC)COC(=O)CCCCCN(CCCCCC(=O)OCC(CCCCCC)CCCCCCCC)CCCN(C)CCCN(CCCCCC(=O)OCC(CCCCCC)CCCCCCCC)CCCCCC(=O)OCC(CCCCCC)CCCCCCCC] |

TABLE 6-continued
Representative cationic lipids of structure (VII)
| No. | Structure |
|---|---|
| VII-7 | 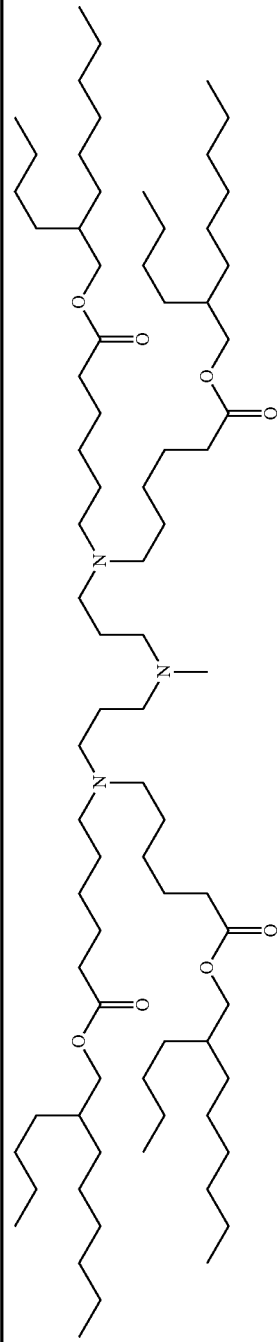 |
| VII-8 | 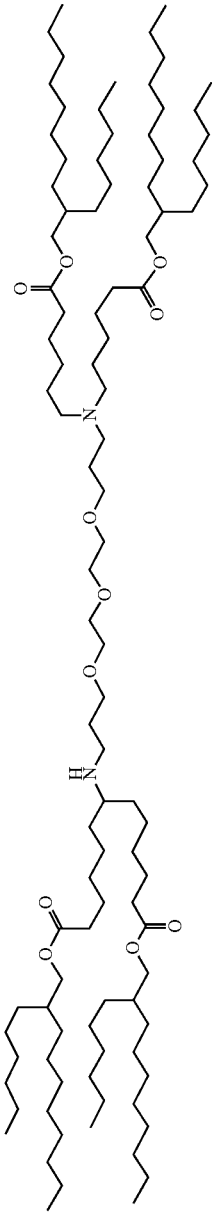 |
| VII-9 | 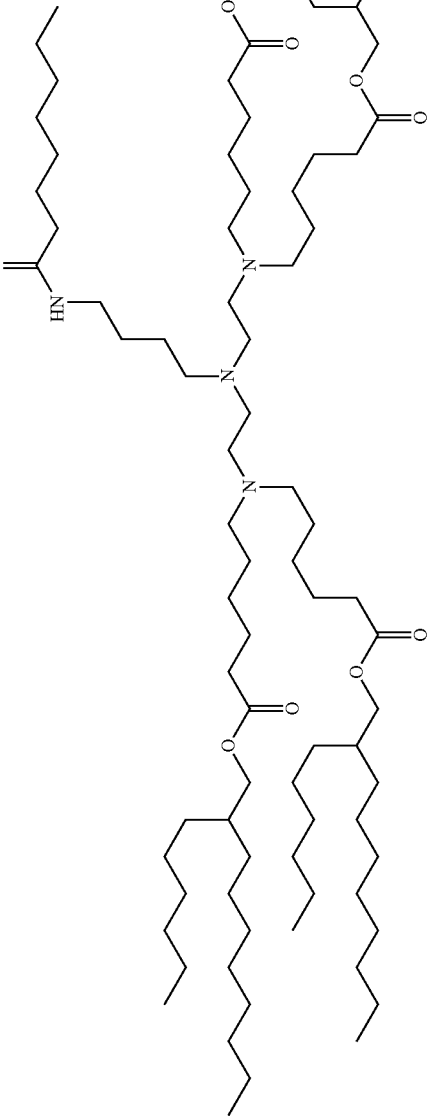 |

TABLE 6-continued

Representative cationic lipids of structure (VII)

| No. | Structure |
|-----|-----------|
| VII-10 | 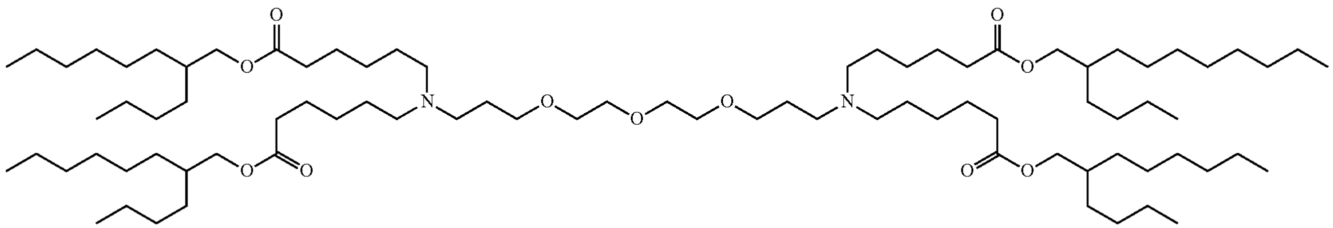 [SMILES: CCCCCCCCC(CCCC)COC(=O)CCCCCN(CCCCCC(=O)OCC(CCCC)CCCCCC)CCCOCCOCCOCCCN(CCCCCC(=O)OCC(CCCC)CCCCCC)CCCCCC(=O)OCC(CCCC)CCCCCC] |
| VII-11 | 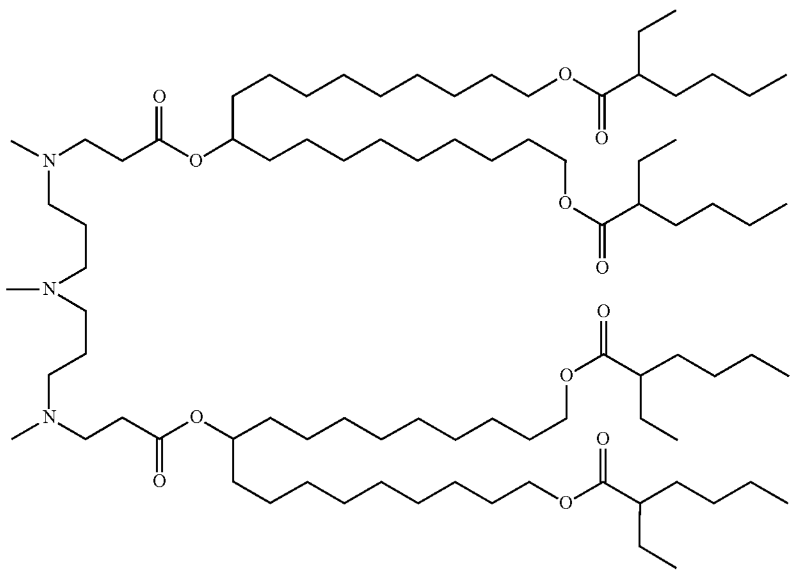 [SMILES: CCCCC(CC)C(=O)OCCCCCCCCCC(CCCCCCCCCOC(=O)C(CC)CCCC)OC(=O)CCN(C)CCCN(C)CCCN(C)CCC(=O)OC(CCCCCCCCCOC(=O)C(CC)CCCC)CCCCCCCCCOC(=O)C(CC)CCCC] |

In one embodiment, the cationic lipid is a compound having the following structure (VIII):

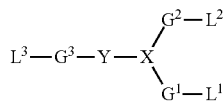

(VIII)

or a pharmaceutically acceptable salt, prodrug or stereoisomer thereof, wherein:

X is N, and Y is absent; or X is CR, and Y is NR;

$L^1$ is —O(C=O)$R^1$, —(C=O)O$R^1$, —C(=O)$R^1$, —O$R^1$, —S(O)$_x$$R^1$, —S—S$R^1$, —C(=O)S$R^1$, —SC(=O)$R^1$, —N$R^a$C(=O)$R^1$, —C(=O)N$R^b$$R^c$, —N$R^a$C(=O)N$R^b$$R^c$, —OC(=O)N$R^b$$R^c$ or —N$R^a$C(=O)O$R^1$;

$L^2$ is —O(C=O)$R^2$, —(C=O)O$R^2$, —C(=O)$R^2$, —O$R^2$, —S(O)$_x$$R^2$, —S—S$R^2$, —C(=O)S$R^2$, —SC(=O)$R^2$, —N$R^d$C(=O)$R^2$, —C(=O)N$R^e$$R^f$, —N$R^d$C(=O)N$R^e$$R^f$, —OC(=O)N$R^e$$R^f$; —N$R^d$C(=O)O$R^2$ or a direct bond to $R^2$;

$L^3$ is —O(C=O)$R^3$ or —(C=O)O$R^3$ $G^1$ and $G^2$ are each independently $C_2$-$C_{12}$ alkylene or $C_2$-$C_{12}$ alkenylene;

$G^3$ is $C_1$-$C_{24}$ alkylene, $C_2$-$C_{24}$ alkenylene, $C_1$-$C_{24}$ heteroalkylene or $C_2$-$C_{24}$ heteroalkenylene;

$R^a$, $R^b$, $R^d$ and $R^e$ are each independently H or $C_1$-$C_{12}$ alkyl or $C_1$-$C_{12}$ alkenyl;

$R^c$ and $R^f$ are each independently $C_1$-$C_{12}$ alkyl or $C_2$-$C_{12}$ alkenyl;

each R is independently H or $C_1$-$C_{12}$ alkyl;

$R^1$, $R^2$ and $R^3$ are each independently $C_1$-$C_{24}$ alkyl or $C_2$-$C_{24}$ alkenyl; and x is 0, 1 or 2, and wherein each alkyl, alkenyl, alkylene, alkenylene, heteroalkylene and heteroalkenylene is independently substituted or unsubstituted unless otherwise specified.

In more embodiments of structure (I):

X is N, and Y is absent; or X is CR, and Y is NR;

$L^1$ is —O(C=O)$R^1$, —(C=O)O$R^1$, —C(=O)$R^1$, —O$R^1$, —S(O)$_x$$R^1$, —S—S$R^1$, —C(=O)S$R^1$, —SC(=O)$R^1$, —N$R^a$C(=O)$R^1$, —C(=O)N$R^b$$R^c$, —N$R^a$C(=O)N$R^b$$R^c$, —OC(=O)N$R^b$$R^c$ or —N$R^a$C(=O)O$R^1$;

$L^2$ is —O(C=O)$R^2$, —(C=O)O$R^2$, —C(=O)$R^2$, —O$R^2$, —S(O)$_x$$R^2$, —S—S$R^2$, —C(=O)S$R^2$, —SC(=O)$R^2$, —N$R^d$C(=O)$R^2$, —C(=O)N$R^e$$R^f$, —N$R^d$C(=O)N$R^e$$R^f$, —OC(=O)N$R^e$$R^f$; —N$R^d$C(=O)O$R^2$ or a direct bond to $R^2$;

$L^3$ is —O(C=O)$R^3$ or —(C=O)O$R^3$;

$G^1$ and $G^2$ are each independently $C_2$-$C_{12}$ alkylene or $C_2$-$C_{12}$ alkenylene;

$G^3$ is $C_1$-$C_{24}$ alkylene, $C_2$-$C_{24}$ alkenylene, $C_1$-$C_{24}$ heteroalkylene or $C_2$-$C_{24}$ heteroalkenylene when X is CR, and Y is NR; and $G^3$ is $C_1$-$C_{24}$ heteroalkylene or $C_2$-$C_{24}$ heteroalkenylene when X is N, and Y is absent;

$R^a$, $R^b$, $R^d$ and $R^e$ are each independently H or $C_1$-$C_{12}$ alkyl or $C_1$-$C_{12}$ alkenyl;

$R^c$ and $R^f$ are each independently $C_1$-$C_{12}$ alkyl or $C_2$-$C_{12}$ alkenyl;

each R is independently H or $C_1$-$C_{12}$ alkyl;

$R^1$, $R^2$ and $R^3$ are each independently $C_1$-$C_{24}$ alkyl or $C_2$-$C_{24}$ alkenyl; and x is 0, 1 or 2, and wherein each alkyl, alkenyl, alkylene, alkenylene, heteroalkylene and heteroalkenylene is independently substituted or unsubstituted unless otherwise specified.

In other embodiments of structure (I):

X is N and Y is absent, or X is CR and Y is NR;

$L^1$ is —O(C=O)$R^1$, —(C=O)O$R^1$, —C(=O)$R^1$, —O$R^1$, —S(O)$_x$$R^1$, —S—S$R^1$, —C(=O)S$R^1$, —SC(=O)$R^1$, —N$R^a$C(=O)$R^1$, —C(=O)N$R^b$$R^c$, —N$R^a$C(=O)N$R^b$$R^c$, —OC(=O)N$R^b$$R^c$ or —N$R^a$C(=O)O$R^1$;

$L^2$ is —O(C=O)$R^2$, —(C=O)O$R^2$, —C(=O)$R^2$, —O$R^2$, —S(O)$_x$$R^2$, —S—S$R^2$, —C(=O)S$R^2$, —SC(=O)$R^2$, —N$R^d$C(=O)$R^2$, —C(=O)N$R^e$$R^f$, —N$R^d$C(=O)N$R^e$$R^f$, —OC(=O)N$R^e$$R^f$; —N$R^d$C(=O)O$R^2$ or a direct bond to $R^2$;

$L^3$ is —O(C=O)$R^3$ or —(C=O)O$R^3$;

$G^1$ and $G^2$ are each independently $C_2$-$C_{12}$ alkylene or $C_2$-$C_{12}$ alkenylene;

$G^3$ is $C_1$-$C_{24}$ alkylene, $C_2$-$C_{24}$ alkenylene, $C_1$-$C_{24}$ heteroalkylene or $C_2$-$C_{24}$ heteroalkenylene;

$R^a$, $R^b$, $R^d$ and $R^e$ are each independently H or $C_1$-$C_{12}$ alkyl or $C_1$-$C_{12}$ alkenyl;

$R^c$ and $R^f$ are each independently $C_1$-$C_{12}$ alkyl or $C_2$-$C_{12}$ alkenyl;

each R is independently H or $C_1$-$C_{12}$ alkyl;

$R^1$, $R^2$ and $R^3$ are each independently branched $C_6$-$C_{24}$ alkyl or branched $C_6$-$C_{24}$ alkenyl; and x is 0, 1 or 2, and wherein each alkyl, alkenyl, alkylene, alkenylene, heteroalkylene and heteroalkenylene is independently substituted or unsubstituted unless otherwise specified.

In certain embodiments of structure (VIII), $G^3$ is unsubstituted. In more specific embodiments $G^3$ is $C_2$-$C_{12}$ alkylene, for example, in some embodiments $G^3$ is $C_3$-$C_7$ alkylene or in other embodiments $G^3$ is $C_3$-$C_{12}$ alkylene. In some embodiments, $G^3$ is $C_2$ or $C_3$ alkylene.

In other embodiments of structure (VIII), $G^3$ is $C_1$-$C_{12}$ heteroalkylene, for example $C_1$-$C_{12}$ aminylalkylene.

In certain embodiments of structure (VIII), X is N and Y is absent. In other embodiments, X is CR and Y is NR, for example in some of these embodiments R is H.

In some of the foregoing embodiments of structure (VIII), the compound has one of the following structures (VIIIA), (VIIIB), (VIIIC) or (VIIID):

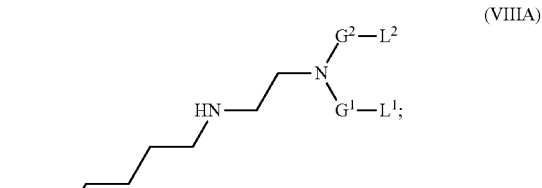

(VIIIA)

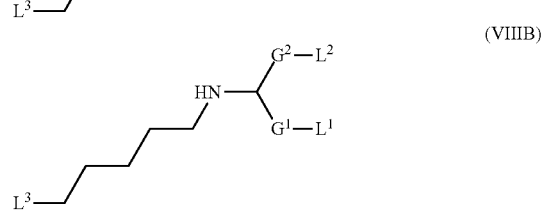

(VIIIB)

-continued

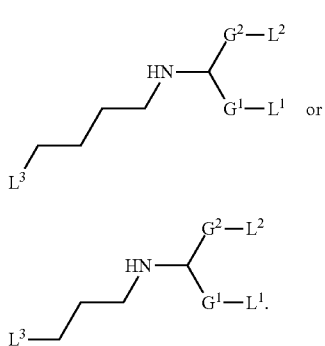

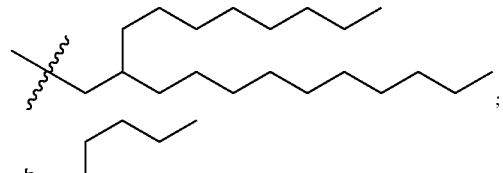

In some of the foregoing embodiments of structure (VIII), L¹ is —O(C=O)R¹, —(C=O)OR¹ or —C(=O)NR$^b$R$^c$, and L² is —O(C=O)R², —(C=O)OR² or —C(=O)NR$^e$R$^f$. In other specific embodiments, L¹ is —(C=O)OR¹ and L² is —(C=O)OR². In any of the foregoing embodiments, L³ is —(C=O)OR³.

In some of the foregoing embodiments of structure (VIII), G¹ and G² are each independently $C_2$-$C_{12}$ alkylene, for example $C_4$-$C_{10}$ alkylene.

In some of the foregoing embodiments of structure (VIII), $R^1$, $R^2$ and $R^3$ are each, independently branched $C_6$-$C_{24}$ alkyl. For example, in some embodiments, $R^1$, $R^2$ and $R^3$ each, independently have the following structure:

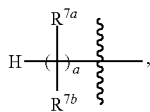

wherein:
$R^{7a}$ and $R^{7b}$ are, at each occurrence, independently H or $C_1$-$C_{12}$ alkyl; and
a is an integer from 2 to 12,
wherein $R^{7a}$, $R^{7b}$ and a are each selected such that $R^1$ and $R^2$ each independently comprise from 6 to 20 carbon atoms. For example, in some embodiments a is an integer ranging from 5 to 9 or from 8 to 12.

In some of the foregoing embodiments of structure (VIII), at least one occurrence of $R^{7a}$ is H. For example, in some embodiments, $R^{7a}$ is H at each occurrence. In other different embodiments of the foregoing, at least one occurrence of $R^{7b}$ is $C_1$-$C_8$ alkyl. For example, in some embodiments, $C_1$-$C_8$ alkyl is methyl, ethyl, n-propyl, iso-propyl, n-butyl, iso-butyl, tert-butyl, n-hexyl or n-octyl.

In some of the foregoing embodiments of structure (VIII), X is CR, Y is NR and R³ is $C_1$-$C_{12}$ alkyl, such as ethyl, propyl or butyl. In some of these embodiments, $R^1$ and $R^2$ are each independently branched $C_6$-$C_{24}$ alkyl.

In different embodiments of structure (VIII), $R^1$, $R^2$ and $R^3$ each, independently have one of the following structures:

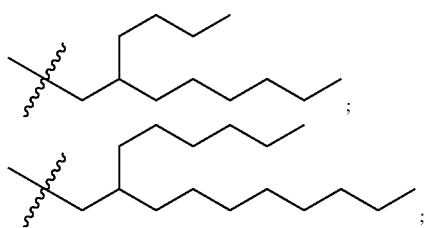

In certain embodiments of structure (VIII), $R^1$ and $R^2$ and $R^3$ are each, independently, branched $C_6$-$C_{24}$ alkyl and $R^3$ is $C_1$-$C_{24}$ alkyl or $C_2$-$C_{24}$ alkenyl.

In some of the foregoing embodiments of structure (VIII), $R^b$, $R^c$, $R^e$ and $R^f$ are each independently $C_3$-$C_{12}$ alkyl. For example, in some embodiments $R^b$, $R^c$, $R^e$ and $R^f$ are n-hexyl and in other embodiments $R^b$, $R^c$, $R^e$ and $R^f$ are n-octyl.

In various different embodiments of structure (VIII), the compound has one of the structures set forth in Table 7 below.

TABLE 7
Representative cationic lipids of structure (VIII)
| No. | Structure |
|---|---|
| VIII-1 | 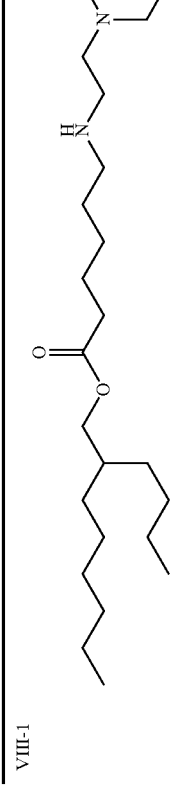 |
| VIII-2 | 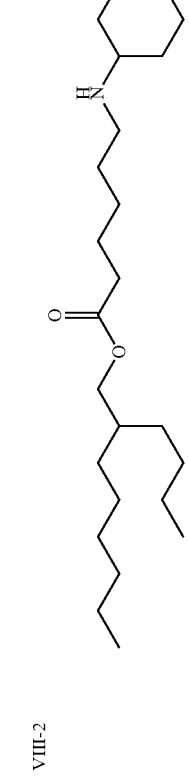 |
| VIII-3 | 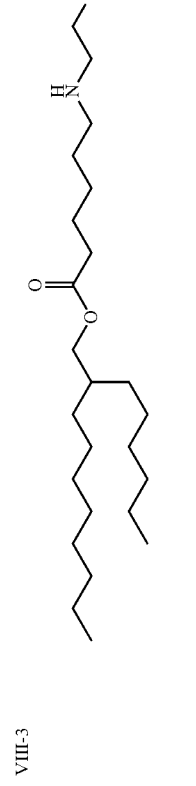 |

TABLE 7-continued

Representative cationic lipids of structure (VIII)

| No. | Structure |
|---|---|
| VIII-4 | 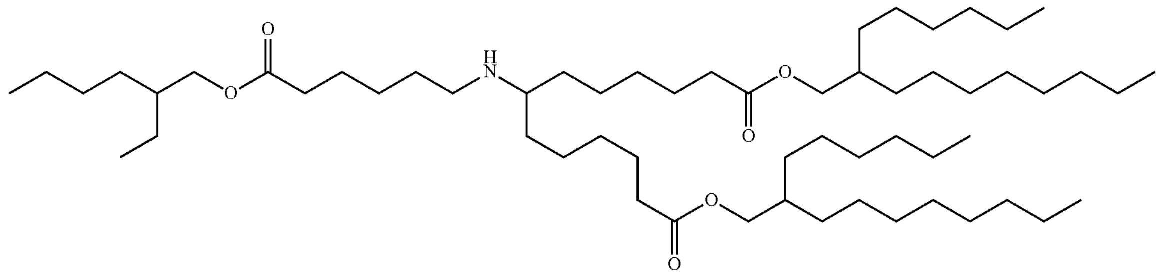 [SMILES: CCCCCCCCC(CCCCCC)COC(=O)CCCCCC(CCCCCC(=O)OCC(CCCCCC)CCCCCCCC)NCCCCCC(=O)OCC(CC)CCCC] |
| VIII-5 | 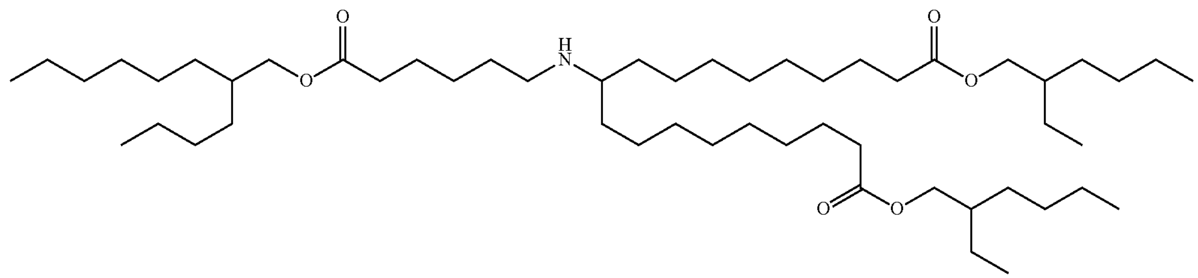 [SMILES: CCCCCCC(CCCC)COC(=O)CCCCCNC(CCCCCCCCC(=O)OCC(CC)CCCC)CCCCCCCCC(=O)OCC(CC)CCCC] |
| VIII-6 | 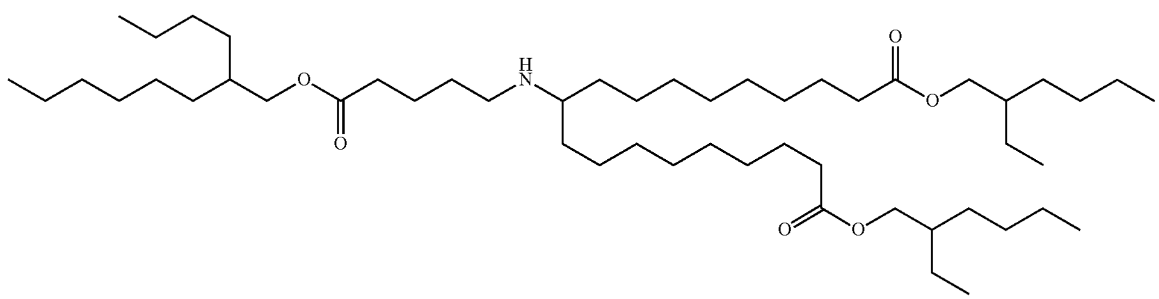 [SMILES: CCCCCCC(CCCC)COC(=O)CCCCNC(CCCCCCCCC(=O)OCC(CC)CCCC)CCCCCCCCC(=O)OCC(CC)CCCC] |

TABLE 7-continued

Representative cationic lipids of structure (VIII)

| No. | Structure |
|---|---|
| VIII-7 | 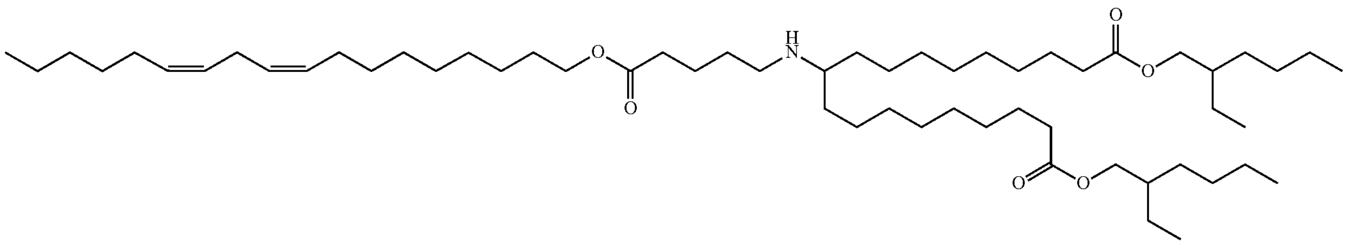 [SMILES: CCCCC/C=C\C/C=C\CCCCCCCCOC(=O)CCCCNC(CCCCCCCCC(=O)OCC(CC)CCCC)CCCCCCCCC(=O)OCC(CC)CCCC] |
| VIII-8 | 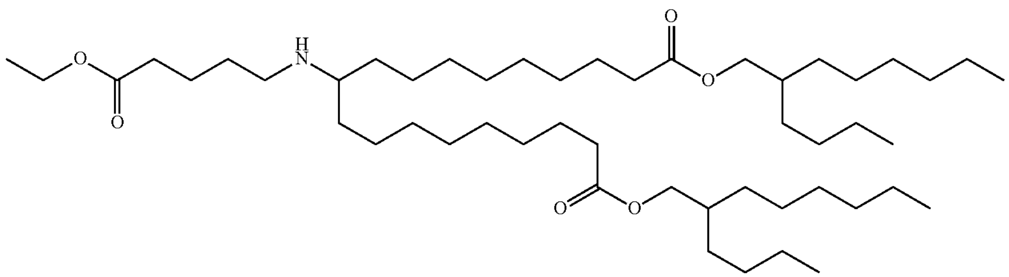 [SMILES: CCCCCCC(CCCC)COC(=O)CCCCCCCCC(CCCCCCCCC(=O)OCC(CCCC)CCCCCC)NCCCCC(=O)OCC] |
| VIII-9 | 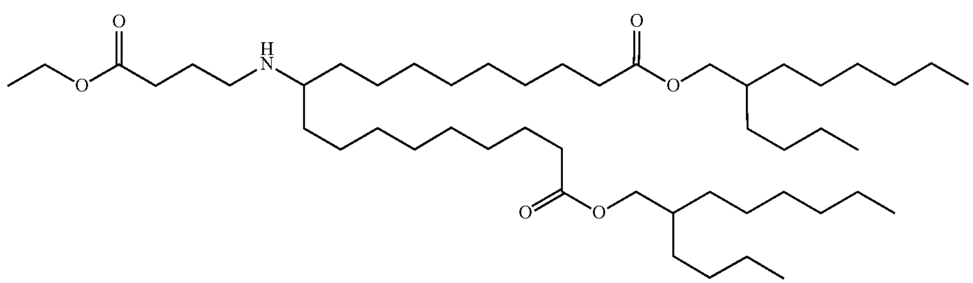 [SMILES: CCCCCCC(CCCC)COC(=O)CCCCCCCCC(CCCCCCCCC(=O)OCC(CCCC)CCCCCC)NCCCC(=O)OCC] |

TABLE 7-continued

Representative cationic lipids of structure (VIII)

| No. | Structure |
|-----|-----------|
| VIII-10 | 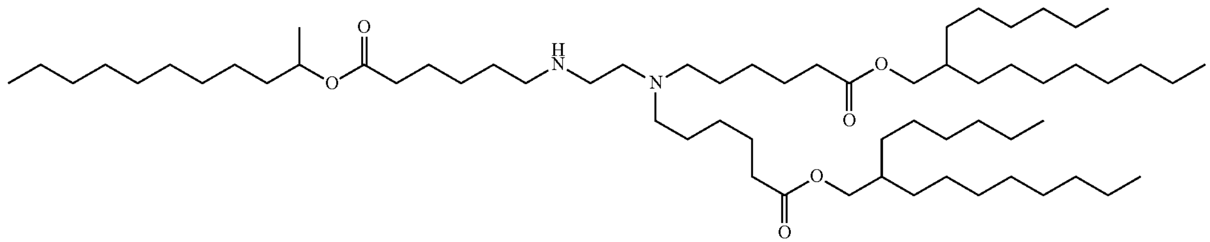 [SMILES: CCCCCCCCCC(C)OC(=O)CCCCCNCCN(CCCCCC(=O)OCC(CCCCCC)CCCCCCCC)CCCCCC(=O)OCC(CCCCCC)CCCCCCCC] |
| VIII-11 | 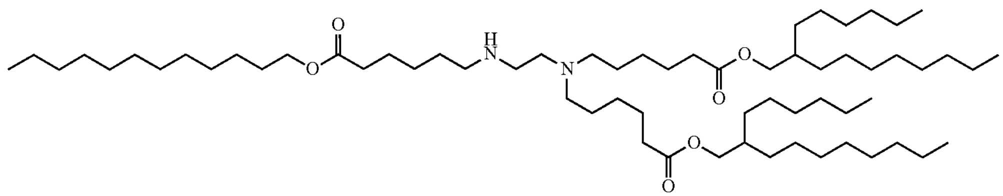 [SMILES: CCCCCCCCCCCCOC(=O)CCCCCNCCN(CCCCCC(=O)OCC(CCCCCC)CCCCCCCC)CCCCCC(=O)OCC(CCCCCC)CCCCCCCC] |
| VIII-12 | 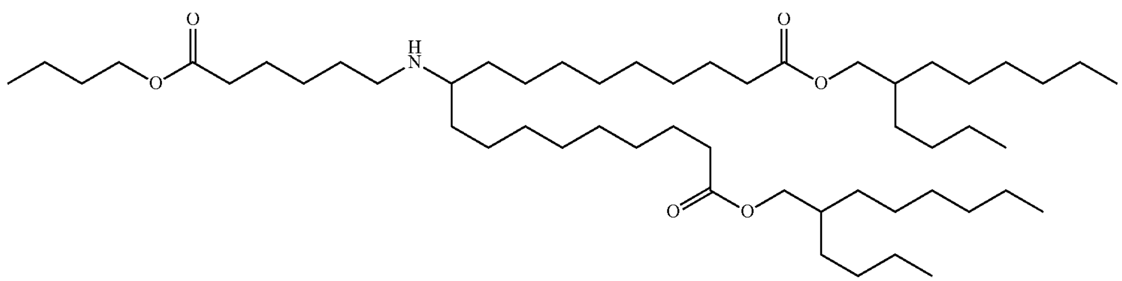 [SMILES: CCCCCCC(CCCC)COC(=O)CCCCCCCCC(CCCCCCCCC(=O)OCC(CCCC)CCCCCC)NCCCCCC(=O)OCCCC] |

In one embodiment, the cationic lipid is a compound having the following structure (IX):

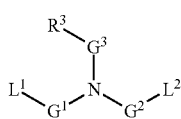
(IX)

or a pharmaceutically acceptable salt, prodrug or stereoisomer thereof, wherein:

$L^1$ is —O(C=O)$R^1$, —(C=O)O$R^1$, —C(=O)$R^1$, —O$R^1$, —S(O)$_x$$R^1$, —S—S$R^1$, —C(=O)S$R^1$, —SC(=O)$R^1$, —N$R^a$C(=O)$R^1$, —C(=O)N$R^b$$R^4$, —N$R^a$C(=O)N$R^b$$R^c$, —OC(=O)N$R^b$$R^c$ or —N$R^a$C(=O)O$R^1$;

$L^2$ is —O(C=O)$R^2$, —(C=O)O$R^2$, —C(=O)$R^2$, —O$R^2$, —S(O)$_x$$R^2$, —S—S$R^2$, —C(=O)S$R^2$, —SC(=O)$R^2$, —N$R^d$C(=O)$R^2$, —C(=O)N$R^e$$R^f$, —N$R^d$C(=O)N$R^e$$R^f$, —OC(=O)N$R^e$$R^f$, —N$R^d$C(=O)O$R^2$ or a direct bond to $R^2$;

$G^1$ and $G^2$ are each independently $C_2$-$C_{12}$ alkylene or $C_2$-$C_{12}$ alkenylene;

$G^3$ is $C_1$-$C_{24}$ alkylene, $C_2$-$C_{24}$ alkenylene, $C_3$-$C_5$ cycloalkylene or $C_3$-$C_8$ cycloalkenylene;

$R^a$, $R^b$, $R^d$ and $R^e$ are each independently H or $C_1$-$C_{12}$ alkyl or $C_1$-$C_2$ alkenyl;

$R^c$ and $R^f$ are each independently $C_1$-$C_{12}$ alkyl or $C_2$-$C_{12}$ alkenyl;

$R^1$ and $R^2$ are each independently branched $C_6$-$C_{24}$ alkyl or branched $C_6$-$C_{24}$ alkenyl;

$R^3$ is —N($R^4$)$R^5$;

$R^4$ is $C_1$-$C_{12}$ alkyl;

$R^5$ is substituted $C_1$-$C_1$ alkyl; and x is 0, 1 or 2, and wherein each alkyl, alkenyl, alkylene, alkenylene, cycloalkylene, cycloalkenylene, aryl and aralkyl is independently substituted or unsubstituted unless otherwise specified.

In certain embodiments of structure (XI), $G^3$ is unsubstituted. In more specific embodiments $G^3$ is $C_2$-$C_{12}$ alkylene, for example, in some embodiments $G^3$ is $C_3$-$C_7$ alkylene or in other embodiments $G^3$ is $C_3$-$C_{12}$ alkylene. In some embodiments, $G^3$ is $C_2$ or $C_3$ alkylene.

In some of the foregoing embodiments of structure (IX), the compound has the following structure (IX A):

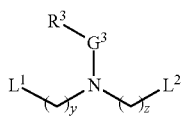
(IXA)

wherein y and z are each independently integers ranging from 2 to 12, for example an integer from 2 to 6, from 4 to 10, or for example 4 or 5. In certain embodiments, y and z are each the same and selected from 4, 5, 6, 7, 8 and 9.

In some of the foregoing embodiments of structure (IX), $L^1$ is —O(C=O)$R^1$, —(C=O)O$R^1$ or —C(=O)N$R^b$$R^c$, and $L^2$ is —O(C=O)$R^2$, —(C=O)O$R^2$ or —C(=O)N$R^e$$R^f$. For example, in some embodiments $L^1$ and $L^2$ are —(C=O)O$R^1$ and —(C=O)O$R^2$, respectively. In other embodiments $L^1$ is —(C=O)O$R^1$ and $L^2$ is —C(=O)N$R^e$$R^f$. In other embodiments $L^1$ is —C(=O)N$R^b$$R^c$ and $L^2$ is —C(=O)N$R^e$$R^f$.

In other embodiments of the foregoing, the compound has one of the following structures (IXB), (IXC), (IXD) or (IXE):

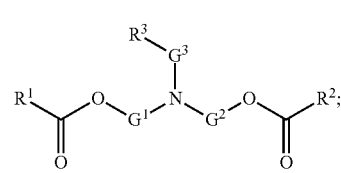
(IXB)

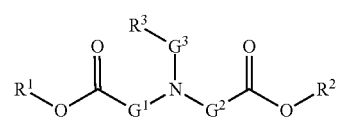
(IXC)

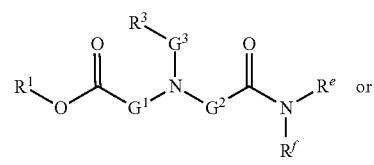
(IXD)

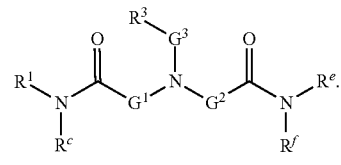
(IXE)

In some of the foregoing embodiments, the compound has structure (IXB), in other embodiments, the compound has structure (IXC) and in still other embodiments the compound has the structure (IXD). In other embodiments, the compound has structure (IXE).

In some different embodiments of the foregoing, the compound has one of the following structures (IXF), (IXG), (IXH) or (IXJ):

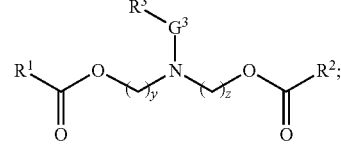
(IXF)

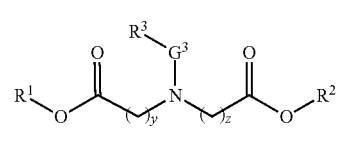
(IXG)

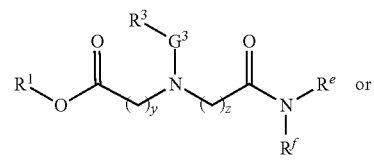
(IXH)

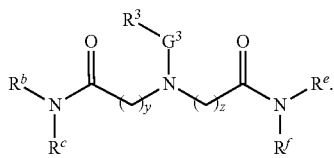

(IXJ)

wherein y and z are each independently integers ranging from 2 to 12, for example an integer from 2 to 6, for example 4.

In some of the foregoing embodiments of structure (IX), y and z are each independently an integer ranging from 2 to 10, 2 to 8, from 4 to 10 or from 4 to 7. For example, in some embodiments, y is 4, 5, 6, 7, 8, 9, 10, 11 or 12. In some embodiments, z is 4, 5, 6, 7, 8, 9, 10, 11 or 12. In some embodiments, y and z are the same, while in other embodiments y and z are different.

In some of the foregoing embodiments of structure (IX), $R^1$ or $R^2$, or both is branched $C_6$-$C_{24}$ alkyl. For example, in some embodiments, $R^1$ and $R^2$ each, independently have the following structure:

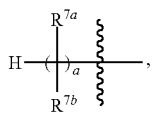

wherein:
$R^{7a}$ and $R^{7b}$ are, at each occurrence, independently H or $C_1$-$C_{12}$ alkyl; and
a is an integer from 2 to 12,
wherein $R^a$, $R^{7b}$ and a are each selected such that $R^1$ and $R^2$ each independently comprise from 6 to 20 carbon atoms. For example, in some embodiments a is an integer ranging from 5 to 9 or from 8 to 12.

In some of the foregoing embodiments of structure (IX), at least one occurrence of $R^{7a}$ is H. For example, in some embodiments, $R^{7a}$ is H at each occurrence. In other different embodiments of the foregoing, at least one occurrence of $R^{7b}$ is $C_1$-$C_8$ alkyl. For example, in some embodiments, $C_1$-$C_8$ alkyl is methyl, ethyl, n-propyl, iso-propyl, n-butyl, iso-butyl, tert-butyl, n-hexyl or n-octyl.

In different embodiments of structure (IX), $R^1$ or $R^2$, or both, has one of the following structures:

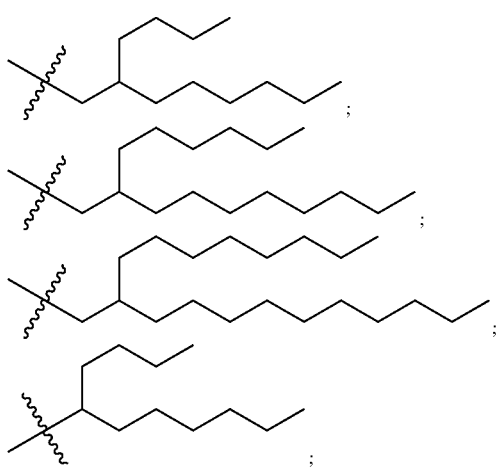

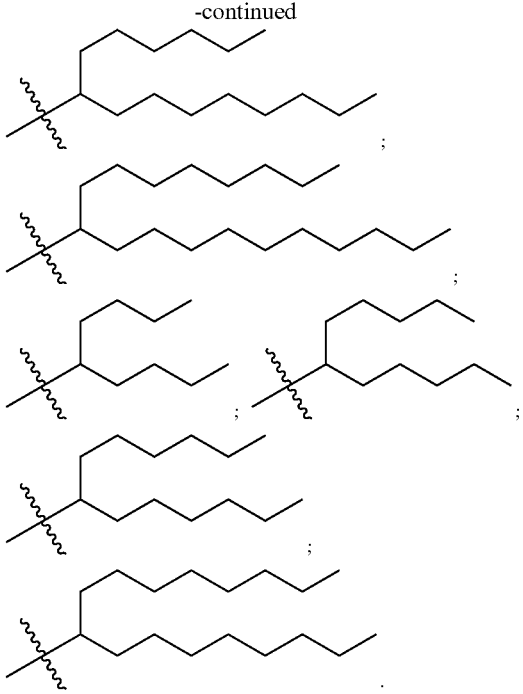

In some of the foregoing embodiments of structure (IX), $R^b$, $R^c$, $R^e$ and $R^f$ are each independently $C_3$-$C_{12}$ alkyl. For example, in some embodiments $R^b$, $R^c$, $R^e$ and $R^f$ are n-hexyl and in other embodiments $R^b$, $R^c$, $R^e$ and $R^f$ are n-octyl.

In any of the foregoing embodiments of structure (IX), $R^4$ is substituted or unsubstituted: methyl, ethyl, propyl, n-butyl, n-hexyl, n-octyl or n-nonyl. For example, in some embodiments $R^4$ is unsubstituted. In other $R^4$ is substituted with one or more substituents selected from the group consisting of —$OR^g$, —$NR^gC(=O)R^h$, —$C(=O)NR^gR^h$, —$C(=O)R^h$, —$OC(=O)R^h$, —$C(=O)OR^h$ and —$OR^iOH$, wherein:

$R^g$ is, at each occurrence independently H or $C_1$-$C_6$ alkyl;
$R^h$ is at each occurrence independently $C_1$-$C_6$ alkyl; and
$R^i$ is, at each occurrence independently $C_1$-$C_6$ alkylene.

In other of the foregoing embodiments of structure (IX), $R^5$ is substituted: methyl ethyl, propyl, n-butyl n-hexyl n-octyl or n-nonyl. In some embodiments, $R^5$ is substituted ethyl or substituted propyl. In other different embodiments, $R^5$ is substituted with hydroxyl. In still more embodiments, $R^5$ is substituted with one or more substituents selected from the group consisting of —$OR^g$, —$NR^gC(=O)R^h$, —$C(=O)NR^gR^h$, —$C(=O)R^h$, —$OC(=O)R^h$, —$C(=O)OR^h$ and —$OR^iOH$, wherein:

$R^g$ is, at each occurrence independently H or $C_1$-$C_6$ alkyl;
$R^h$ is at each occurrence independently $C_1$-$C_6$ alkyl; and
$R^i$ is, at each occurrence independently $C_1$-$C_6$ alkylene.

In other embodiments of structure (IX), $R^4$ is unsubstituted methyl, and $R^5$ is substituted: methyl, ethyl, propyl, n-butyl, n-hexyl, n-octyl or n-nonyl. In some of these embodiments, $R^5$ is substituted with hydroxyl.

In some other specific embodiments of structure (IX), $R^3$ has one of the following structures:

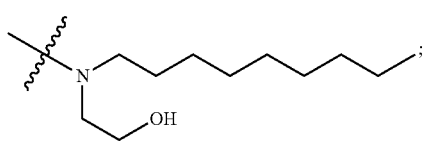
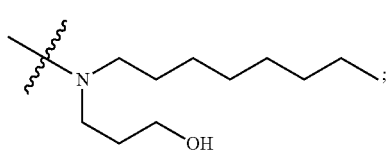
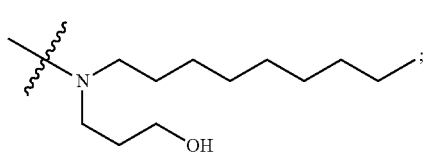
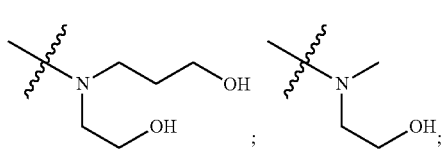
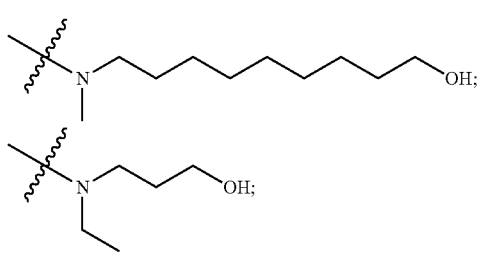
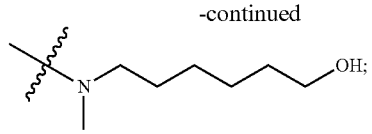
-continued
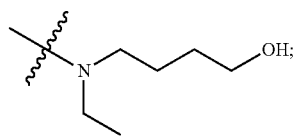
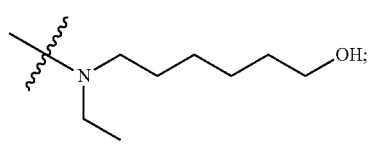
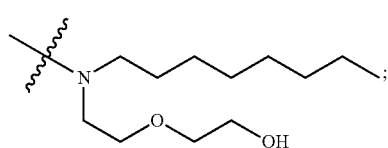
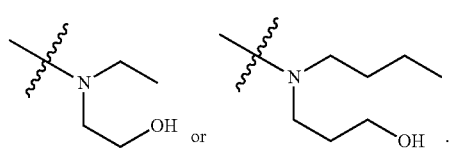
In various different embodiments of structure (IX), the cationic lipid has one of the structures set forth in Table 8 below.
TABLE 8
Representative cationic lipids of structure (IX)
| No. | Structure |
|---|---|
| IX-1 | 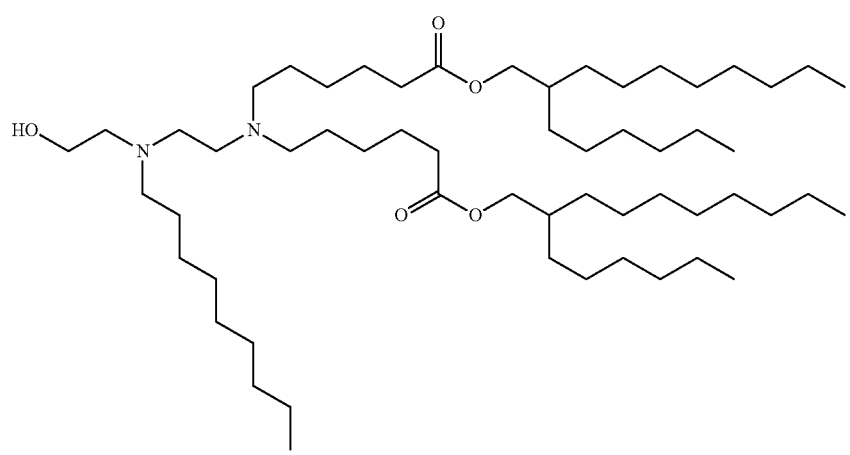 [SMILES: CCCCCCCCCN(CCO)CCN(CCCCCC(=O)OCC(CCCCCC)CCCCCCCC)CCCCCC(=O)OCC(CCCCCC)CCCCCCCC] |

TABLE 8-continued
Representative cationic lipids of structure (IX)
| No. | Structure |
|---|---|
| IX-2 | 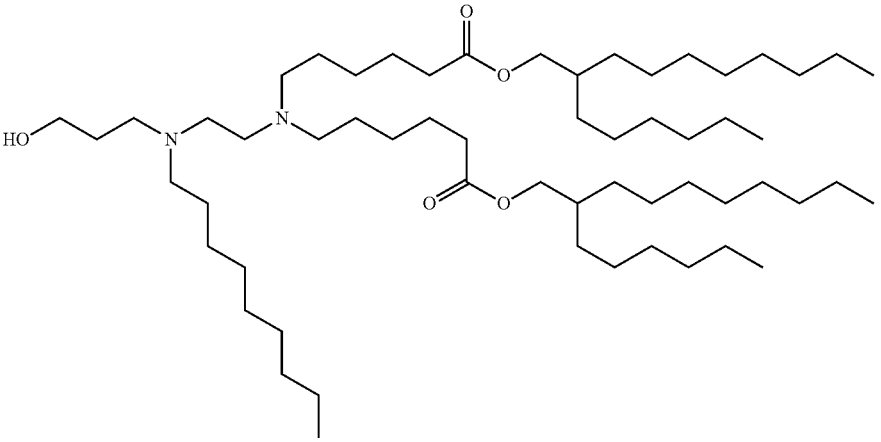 [SMILES: CCCCCCCCCN(CCCO)CCN(CCCCCC(=O)OCC(CCCCCC)CCCCCCCC)CCCCCC(=O)OCC(CCCCCC)CCCCCCCC] |
| IX-3 | 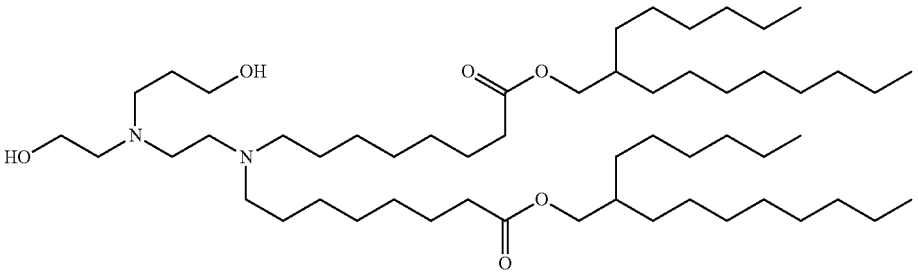 [SMILES: CCCCCCCCC(CCCCCC)COC(=O)CCCCCCCN(CCCCCCCC(=O)OCC(CCCCCC)CCCCCCCC)CCN(CCO)CCCO] |
| IX-4 | 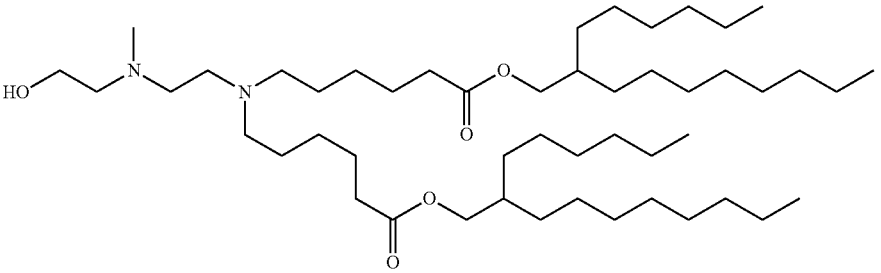 [SMILES: CCCCCCCCC(CCCCCC)COC(=O)CCCCCN(CCCCCC(=O)OCC(CCCCCC)CCCCCCCC)CCN(C)CCO] |
| IX-5 | 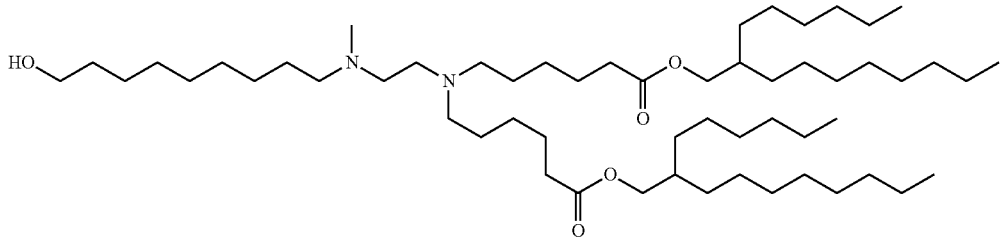 [SMILES: CCCCCCCCC(CCCCCC)COC(=O)CCCCCN(CCCCCC(=O)OCC(CCCCCC)CCCCCCCC)CCN(C)CCCCCCCCCO] |
| IX-6 | 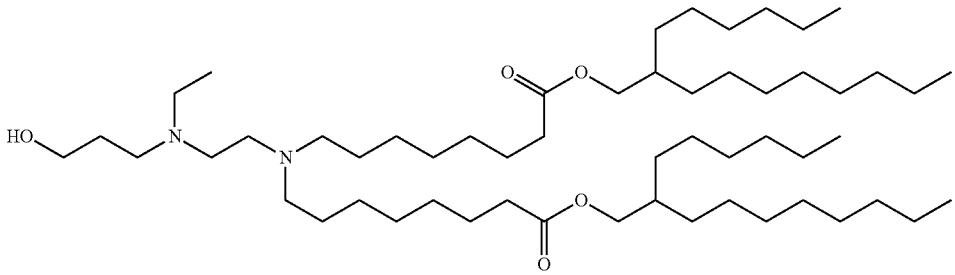 [SMILES: CCCCCCCCC(CCCCCC)COC(=O)CCCCCCCN(CCCCCCCC(=O)OCC(CCCCCC)CCCCCCCC)CCN(CC)CCCO] |

TABLE 8-continued

Representative cationic lipids of structure (IX)

| No. | Structure |
|---|---|
| IX-7 | 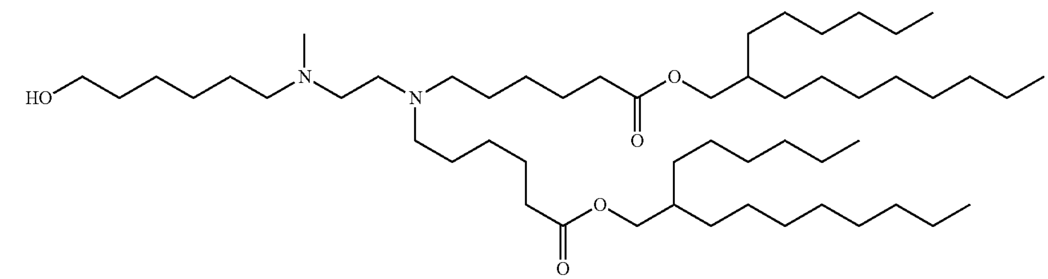 [SMILES: CCCCCCCCC(CCCCCC)COC(=O)CCCCCN(CCCCCC(=O)OCC(CCCCCC)CCCCCCCC)CCN(C)CCCCCCO] |
| IX-8 | 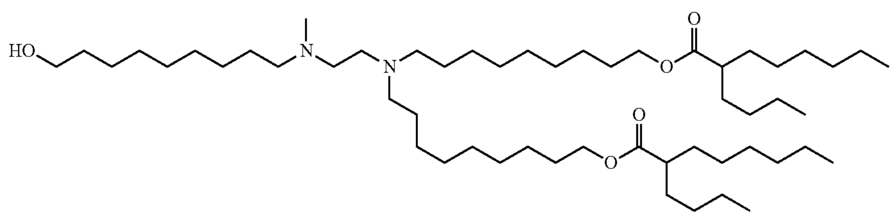 [SMILES: CCCCCCC(CCCC)C(=O)OCCCCCCCCCN(CCCCCCCCCOC(=O)C(CCCC)CCCCCC)CCN(C)CCCCCCCCCO] |
| IX-9 | 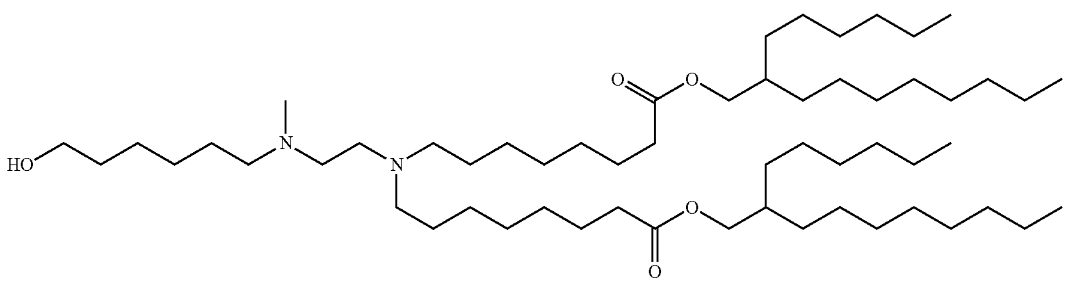 [SMILES: CCCCCCCCC(CCCCCC)COC(=O)CCCCCCCN(CCCCCCCC(=O)OCC(CCCCCC)CCCCCCCC)CCN(C)CCCCCCO] |
| IX-10 | 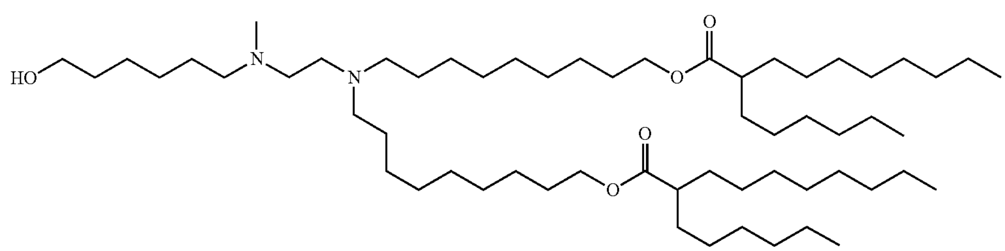 [SMILES: CCCCCCCCC(CCCCCC)C(=O)OCCCCCCCCCN(CCCCCCCCCOC(=O)C(CCCCCCC)CCCCCCCC)CCN(C)CCCCCCO] |
| IX-11 | 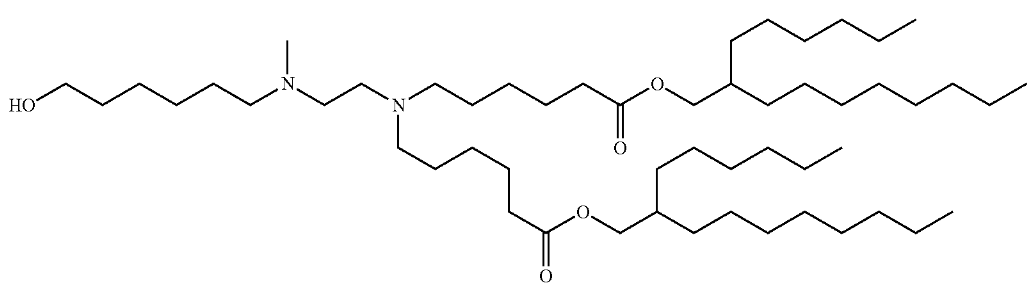 [SMILES: CCCCCCCCC(CCCCCC)COC(=O)CCCCCN(CCCCCC(=O)OCC(CCCCCC)CCCCCCCC)CCN(C)CCCCCCO] |

TABLE 8-continued

Representative cationic lipids of structure (IX)

| No. | Structure |
|---|---|
| IX-12 | 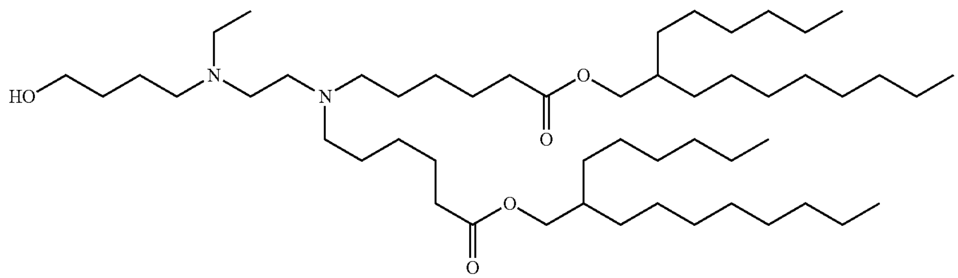 [SMILES: CCCCCCCCC(CCCCCC)COC(=O)CCCCCN(CCCCCC(=O)OCC(CCCCCC)CCCCCCCC)CCN(CC)CCCCO] |
| IX-13 | 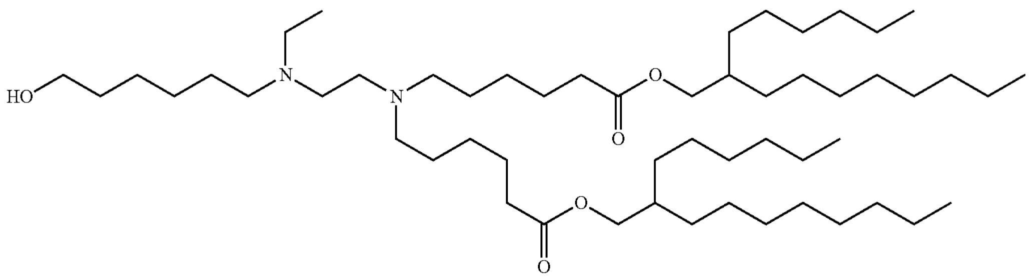 [SMILES: CCCCCCCCC(CCCCCC)COC(=O)CCCCCN(CCCCCC(=O)OCC(CCCCCC)CCCCCCCC)CCN(CC)CCCCCCO] |
| IX-14 | 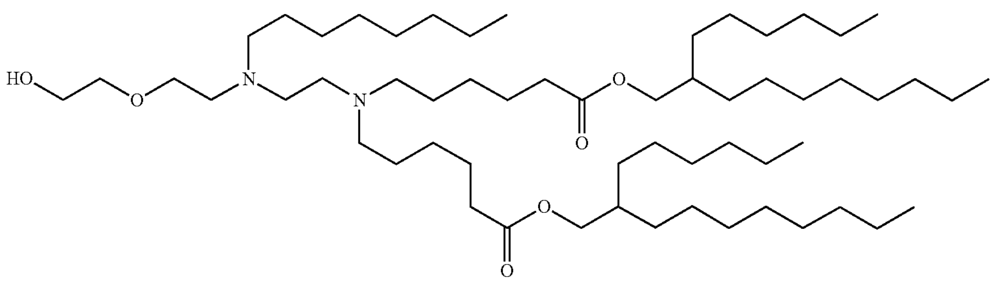 [SMILES: CCCCCCCCC(CCCCCC)COC(=O)CCCCCN(CCCCCC(=O)OCC(CCCCCC)CCCCCCCC)CCN(CCCCCCCC)CCOCCO] |
| IX-15 | 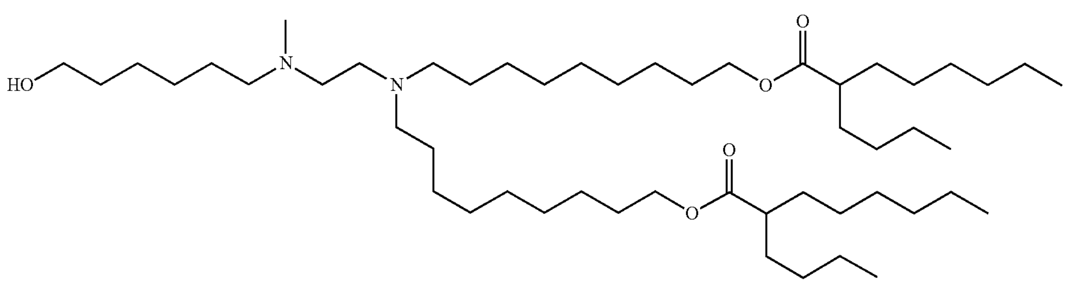 [SMILES: CCCCCCC(CCCC)C(=O)OCCCCCCCCCN(CCCCCCCCCOC(=O)C(CCCC)CCCCCC)CCN(C)CCCCCCO] |
| IX-16 | 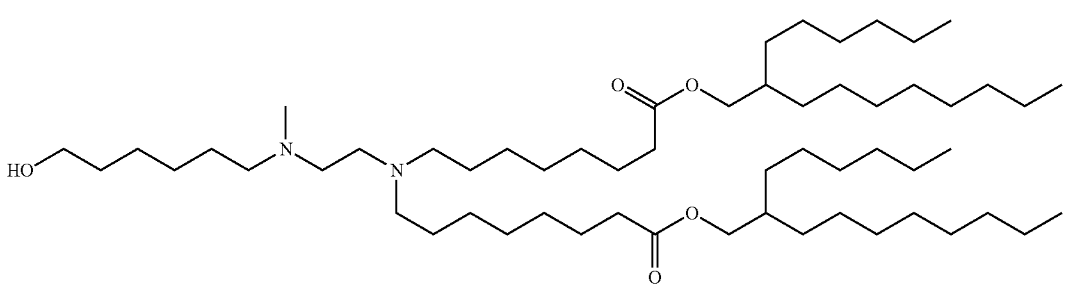 [SMILES: CCCCCCCCC(CCCCCC)COC(=O)CCCCCCCN(CCCCCCCC(=O)OCC(CCCCCC)CCCCCCCC)CCN(C)CCCCCCO] |

TABLE 8-continued

Representative cationic lipids of structure (IX)

| No. | Structure |
|---|---|
| IX-17 | 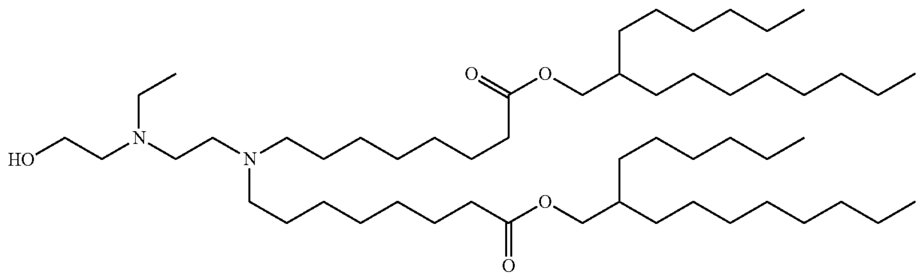 [SMILES: CCCCCCCCC(CCCCCC)COC(=O)CCCCCCCN(CCCCCCCC(=O)OCC(CCCCCC)CCCCCCCC)CCN(CC)CCO] |
| IX-18 | 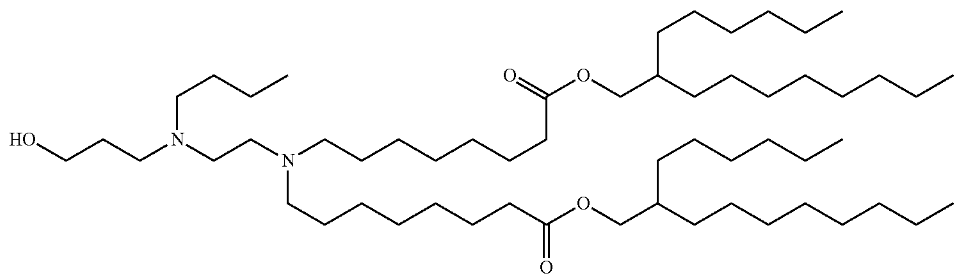 [SMILES: CCCCCCCCC(CCCCCC)COC(=O)CCCCCCCN(CCCCCCCC(=O)OCC(CCCCCC)CCCCCCCC)CCN(CCCC)CCCO] |

In one embodiment, the cationic lipid is a compound having the following structure (X):

(X)

or a pharmaceutically acceptable salt, tautomer, prodrug or stereoisomer thereof, wherein:
  $G^1$ is —OH, —NR$^3$R$^4$, —(C=O)NR$^5$ or —NR$^3$(C=O)R$^5$;
  $G^2$ is —CH$_2$— or —(C=O)—;
  R is, at each occurrence, independently H or OH;
  $R^1$ and $R^2$ are each independently branched, saturated or unsaturated $C_{12}$-$C_{36}$ alkyl;
  $R^3$ and $R^4$ are each independently H or straight or branched, saturated or unsaturated $C_1$-$C_6$ alkyl;
  $R^5$ is straight or branched, saturated or unsaturated $C_1$-$C_6$ alkyl; and
  n is an integer from 2 to 6.

In some embodiments, $R^1$ and $R^2$ are each independently branched, saturated or unsaturated $C_{12}$-$C_{30}$ alkyl, $C_{12}$-$C_{20}$ alkyl, or $C_{15}$-$C_{20}$ alkyl. In some specific embodiments, $R^1$ and $R^2$ are each saturated. In certain embodiments, at least one of $R^1$ and $R^2$ is unsaturated.

In some of the foregoing embodiments of structure (X), $R^1$ and $R^2$ have the following structure:

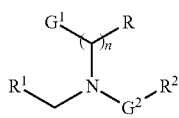

In some of the foregoing embodiments of structure (X), the compound has the following structure (XA):

(XA)

wherein:
  $R^6$ and $R^7$ are, at each occurrence, independently H or straight or branched, saturated or unsaturated $C_1$-$C_{14}$ alkyl;
  a and b are each independently an integer ranging from 1 to 15,
  provided that $R^6$ and a, and $R^7$ and b, are each independently selected such that $R^1$ and $R^2$, respectively, are each independently branched, saturated or unsaturated $C_{12}$-$C_{36}$ alkyl.

In some of the foregoing embodiments, the compound has the following structure (XB):

(XB)

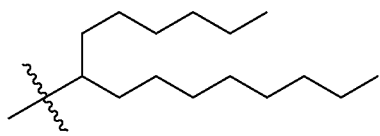

wherein:
  $R^8$, $R^9$, $R^{10}$ and $R^{11}$ are each independently straight or branched, saturated or unsaturated $C_4$-$C_{12}$ alkyl, provided that $R^8$ and $R^9$, and $R^{10}$ and $R^{11}$, are each independently selected such that $R^1$ and $R^2$, respectively, are each independently branched, saturated or unsaturated $C_{12}$-$C_{36}$ alkyl. In some embodiments of (XB), $R^8$, $R^9$, $R^{10}$ and $R^{11}$ are each independently straight or branched, saturated or unsaturated $C_6$-$C_{10}$ alkyl. In certain embodiments of (XB), at least one of $R^8$, $R^9$, $R^{10}$ and $R^{11}$ is unsaturated. In other certain specific embodiments of (XB), each of $R^8$, $R^9$, $R^{10}$ and $R^{11}$ is saturated.

In some of the foregoing embodiments, the compound has structure (XA), and in other embodiments, the compound has structure (XB).

In some of the foregoing embodiments, $G^1$ is —OH, and in some embodiments $G^1$ is —$NR^3R^4$. For example, in some embodiments, $G^1$ is —$NH_2$, —$NHCH_3$ or —$N(CH_3)_2$. In certain embodiments, $G^1$ is —(C=O)$NR^5$. In certain other embodiments, $G^1$ is —$NR^3$(C=O)$R^5$. For example, in some embodiments $G^1$ is —NH(C=O)$CH_3$ or —NH(C=O)$CH_2CH_2CH_3$.

In some of the foregoing embodiments of structure (X), $G^2$ is —$CH_2$—. In some different embodiments, $G^2$ is —(C=O)—.

In some of the foregoing embodiments of structure (X), n is an integer ranging from 2 to 6, for example, in some embodiments n is 2, 3, 4, 5 or 6. In some embodiments, n is 2. In some embodiments, n is 3. In some embodiments, n is 4.

In certain of the foregoing embodiments of structure (X), at least one of $R^1$, $R^2$, $R^3$, $R^4$ and $R^5$ is unsubstituted. For example, in some embodiments, $R^1$, $R^2$, $R^3$, $R^4$ and $R^5$ are each unsubstituted. In some embodiments, $R^3$ is substituted. In other embodiments $R^4$ is substituted. In still more embodiments, $R^5$ is substituted. In certain specific embodiments, each of $R^3$ and $R^4$ are substituted. In some embodiments, a substituent on $R^3$, $R^4$ or $R^5$ is hydroxyl. In certain embodiments, $R^3$ and $R^4$ are each substituted with hydroxyl.

In some of the foregoing embodiments of structure (X), at least one R is OH. In other embodiments, each R is H.

In various different embodiments of structure (X), the compound has one of the structures set forth in Table 9 below.

TABLE 9

Representative cationic lipids of structure (X)

| No. | Structure |
|---|---|
| X-1 | 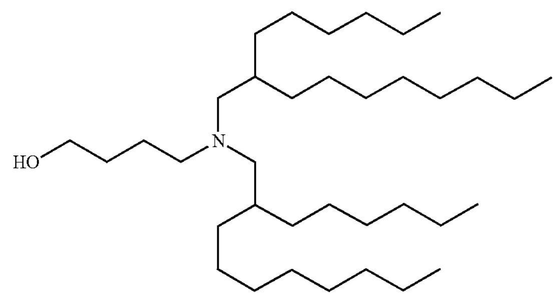 [SMILES: CCCCCCCCC(CCCCCC)CN(CCCCO)CC(CCCCCC)CCCCCCCC] |
| X-2 | 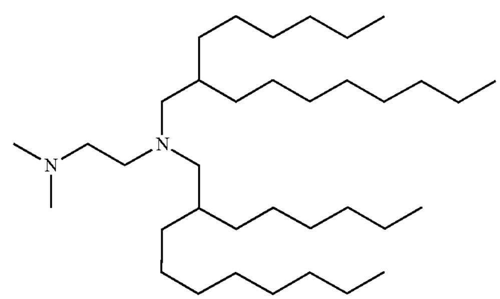 [SMILES: CCCCCCCCC(CCCCCC)CN(CCN(C)C)CC(CCCCCC)CCCCCCCC] |
| X-3 | 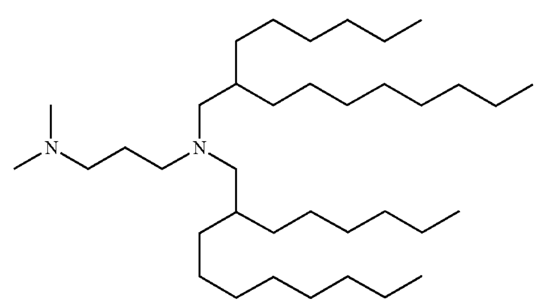 [SMILES: CCCCCCCCC(CCCCCC)CN(CCCN(C)C)CC(CCCCCC)CCCCCCCC] |

TABLE 9-continued
Representative cationic lipids of structure (X)
| No. | Structure |
|---|---|
| X-4 | 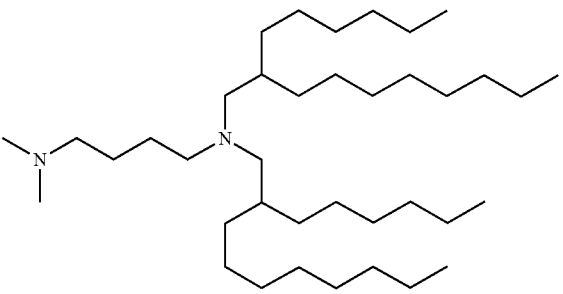 [SMILES: CCCCCCCCC(CCCCCC)CN(CCCCN(C)C)CC(CCCCCC)CCCCCCCC] |
| X-5 | 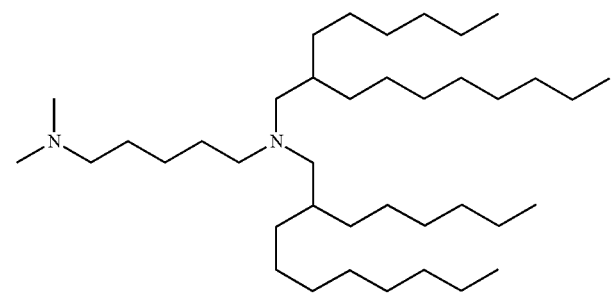 [SMILES: CCCCCCCCC(CCCCCC)CN(CCCCCN(C)C)CC(CCCCCC)CCCCCCCC] |
| X-6 | 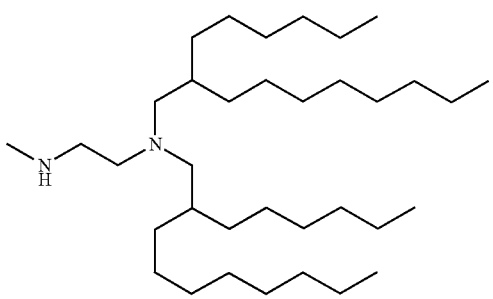 [SMILES: CCCCCCCCC(CCCCCC)CN(CCNC)CC(CCCCCC)CCCCCCCC] |
| X-7 | 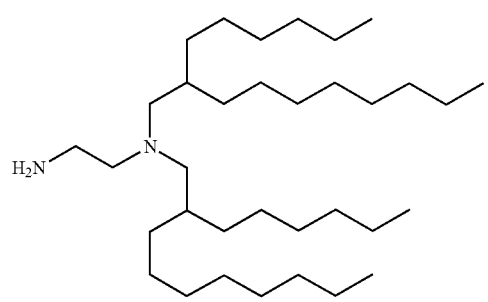 [SMILES: CCCCCCCCC(CCCCCC)CN(CCN)CC(CCCCCC)CCCCCCCC] |
| X-8 | 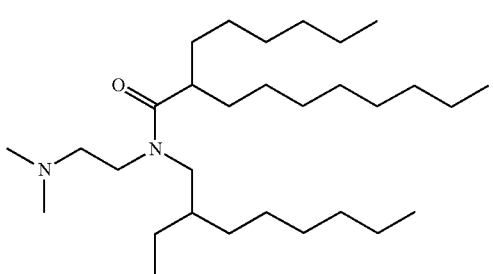 |

TABLE 9-continued
Representative cationic lipids of structure (X)
| No. | Structure |
|---|---|
| X-9 | 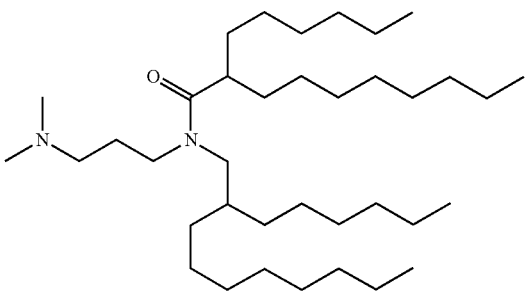 [SMILES: CCCCCCCCC(CCCCCC)CN(CCCN(C)C)C(=O)C(CCCCCC)CCCCCCCC] |
| X-10 | 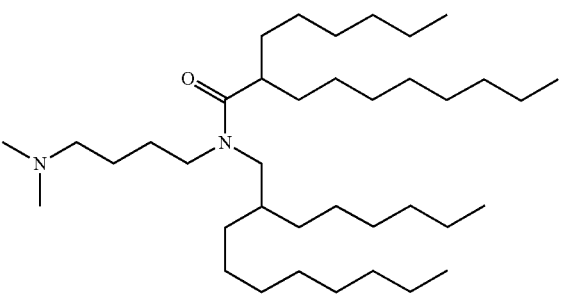 [SMILES: CCCCCCCCC(CCCCCC)CN(CCCCN(C)C)C(=O)C(CCCCCC)CCCCCCCC] |
| X-11 | 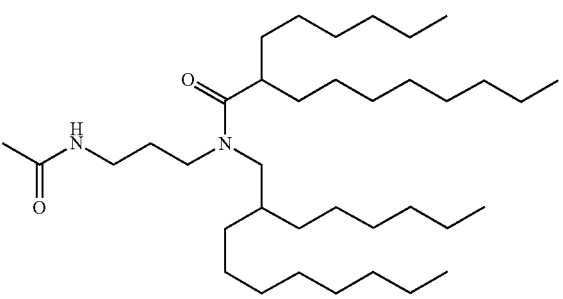 [SMILES: CCCCCCCCC(CCCCCC)CN(CCCNC(C)=O)C(=O)C(CCCCCC)CCCCCCCC] |
| X-12 | 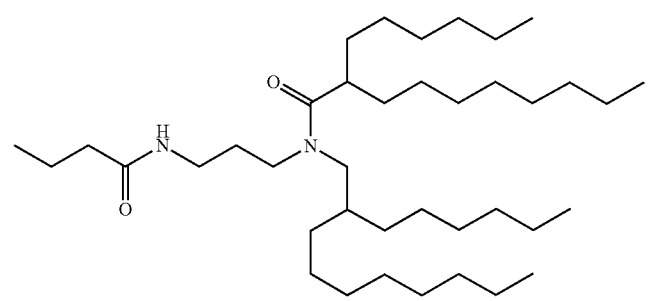 [SMILES: CCCCCCCCC(CCCCCC)CN(CCCNC(=O)CCC)C(=O)C(CCCCCC)CCCCCCCC] |
| X-13 | 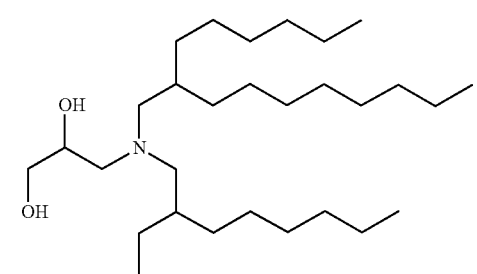 |

TABLE 9-continued

Representative cationic lipids of structure (X)

| No. | Structure |
| --- | --- |
| X-14 | 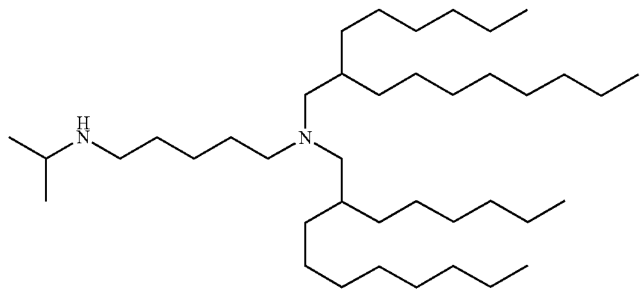 [SMILES: CCCCCCCCC(CCCCCC)CN(CCCCCNC(C)C)CC(CCCCCC)CCCCCCCC] |
| X-15 | 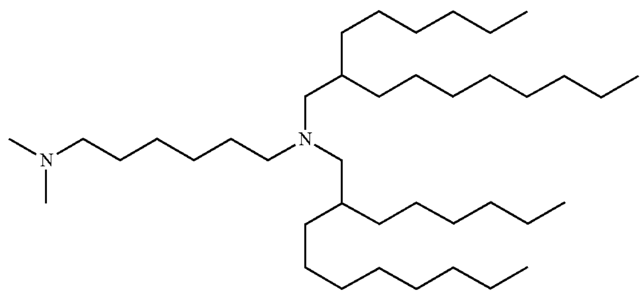 [SMILES: CCCCCCCCC(CCCCCC)CN(CCCCCCN(C)C)CC(CCCCCC)CCCCCCCC] |
| X-16 | 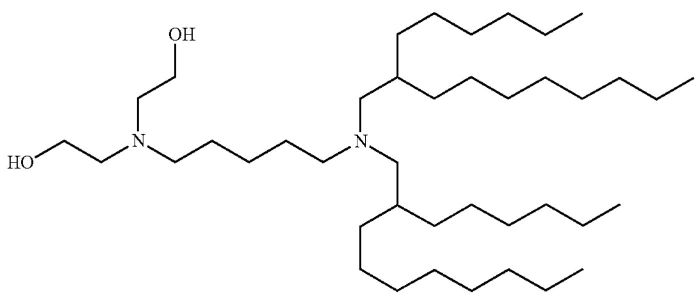 [SMILES: CCCCCCCCC(CCCCCC)CN(CCCCCN(CCO)CCO)CC(CCCCCC)CCCCCCCC] |
| X-17 | 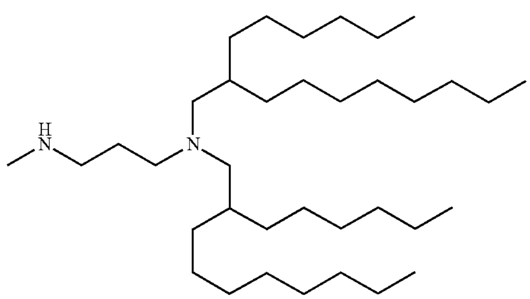 |

In any of Embodiments 1, 2, 3, 4 or 5, the LNPs further comprise a neutral lipid. In various embodiments, the molar ratio of the cationic lipid to the neutral lipid ranges from about 2:1 to about 8:1. In certain embodiments, the neutral lipid is present in any of the foregoing LNPs in a concentration ranging from 5 to 10 mol percent, from 5 to 15 mol percent, 7 to 13 mol percent, or 9 to 11 mol percent. In certain specific embodiments, the neutral lipid is present in a concentration of about 9.5, 10 or 10.5 mol percent. In some embodiments, the molar ratio of cationic lipid to the neutral lipid ranges from about 4.1:1.0 to about 4.9:1.0, from about 4.5:1.0 to about 4.8:1.0, or from about 4.7:1.0 to 4.8:1.0. In some embodiments, the molar ratio of total cationic lipid to the neutral lipid ranges from about 4.1:1.0 to about 4.9:1.0, from about 4.5:1.0 to about 4.8:1.0, or from about 4.7:1.0 to 4.8:1.0.

Exemplary neutral lipids for use in any of Embodiments 1, 2, 3, 4 or 5 include, for example, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoyl-phosphatidylethanolamine (POPE) and dioleoyl-phosphatidylethanolamine 4-(N-maleimidomethyl)-cyclohexane-1carboxylate (DOPE-mal), dipalmitoyl phosphatidyl ethanolamine (DPPE), dimyristoylphosphoethanolamine (DMPE), distearoyl-phosphatidylethanolamine (DSPE), 16-O-monomethyl PE, 16-O-dimethyl PE, 18-1-trans PE, 1-stearioyl-2-oleoylphosphatidyethanolamine (SOPE), and 1,2-dielaidoyl-sn-glycero-3-phophoethanolamine (transDOPE). In one embodiment, the neutral lipid is 1,2-distearoyl-sn-glycero-3phosphocholine (DSPC). In some embodiments, the neutral lipid is selected from DSPC, DPPC, DMPC, DOPC, POPC, DOPE and SM. In some embodiments, the neutral lipid is DSPC.

In various embodiments of Embodiments 1, 2, 3, 4 or 5, any of the disclosed lipid nanoparticles comprise a steroid or steroid analogue. In certain embodiments, the steroid or steroid analogue is cholesterol. In some embodiments, the steroid is present in a concentration ranging from 39 to 49 molar percent, 40 to 46 molar percent, from 40 to 44 molar percent, from 40 to 42 molar percent, from 42 to 44 molar percent, or from 44 to 46 molar percent. In certain specific embodiments, the steroid is present in a concentration of 40, 41, 42, 43, 44, 45, or 46 molar percent.

In certain embodiments, the molar ratio of cationic lipid to the steroid ranges from 1.0:0.9 to 1.0:1.2, or from 1.0:1.0 to 1.0:1.2. In some of these embodiments, the molar ratio of cationic lipid to cholesterol ranges from about 5:1 to 1:1. In certain embodiments, the steroid is present in a concentration ranging from 32 to 40 mol percent of the steroid.

In certain embodiments, the molar ratio of total cationic to the steroid ranges from 1.0:0.9 to 1.0:1.2, or from 1.0:1.0 to 1.0:1.2. In some of these embodiments, the molar ratio of total cationic lipid to cholesterol ranges from about 5:1 to 1:1. In certain embodiments, the steroid is present in a concentration ranging from 32 to 40 mol percent of the steroid.

In some embodiments of Embodiments 1, 2, 3 4 or 5, the LNPs further comprise a polymer conjugated lipid. In various other embodiments of Embodiments 1, 2, 3 4 or 5, the polymer conjugated lipid is a pegylated lipid. For example, some embodiments include a pegylated diacylglycerol (PEG-DAG) such as 1-(monomethoxy-polyethyleneglycol)-2,3-dimyristoylglycerol (PEG-DMG), a pegylated phosphatidylethanoloamine (PEG-PE), a PEG succinate diacylglycerol (PEG-S-DAG) such as 4-O-(2',3'-di(tetradecanoyloxy)propyl-1-O—(ω-methoxy(polyethoxy)ethyl)butanedioate (PEG-S-DMG), a pegylated ceramide (PEG-cer), or a PEG dialkoxypropylcarbamate such as ω-methoxy(polyethoxy)ethyl-N-(2,3-di(tetradecanoxy)propyl)carbamate or 2,3-di(tetradecanoxy)propyl-N-(ω-methoxy(polyethoxy)ethyl)carbamate.

In various embodiments, the polymer conjugated lipid is present in a concentration ranging from 1.0 to 2.5 molar percent. In certain specific embodiments, the polymer conjugated lipid is present in a concentration of about 1.7 molar percent. In some embodiments, the polymer conjugated lipid is present in a concentration of about 1.5 molar percent.

In certain embodiments, the molar ratio of cationic lipid to the polymer conjugated lipid ranges from about 35:1 to about 25:1. In some embodiments, the molar ratio of cationic lipid to polymer conjugated lipid ranges from about 100:1 to about 20:1.

In certain embodiments, the molar ratio of total cationic lipid (i.e., the sum of the first and second cationic lipid) to the polymer conjugated lipid ranges from about 35:1 to about 25:1. In some embodiments, the molar ratio of total cationic lipid to polymer conjugated lipid ranges from about 100:1 to about 20:1.

In some embodiments of Embodiments 1, 2, 3 4 or 5, the pegylated lipid, when present, has the following Formula (XI):

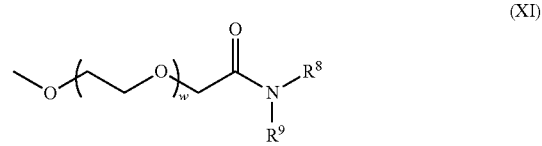

or a pharmaceutically acceptable salt, tautomer or stereoisomer thereof, wherein:
$R^{12}$ and $R^{13}$ are each independently a straight or branched, saturated or unsaturated alkyl chain containing from 10 to 30 carbon atoms, wherein the alkyl chain is optionally interrupted by one or more ester bonds; and
w has a mean value ranging from 30 to 60.

In some embodiments, $R^{12}$ and $R^{13}$ are each independently straight, saturated alkyl chains containing from 12 to 16 carbon atoms. In other embodiments, the average w ranges from 42 to 55, for example, the average w is 42, 43, 44, 45, 46, 47, 48, 49, 50, 51, 52, 53, 54 or 55. In some specific embodiments, the average w is about 49.

In some embodiments, the pegylated lipid has the following Formula (XIa):

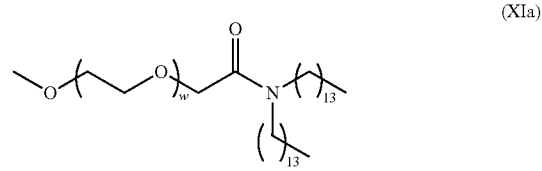

wherein the average w is about 49.

In some embodiments of Embodiments 1, 2, 3 4 or 5, the nucleic acid is selected from antisense and messenger RNA. For example, messenger RNA may be used to induce an immune response (e.g., as a vaccine), for example by translation of immunogenic proteins.

In other embodiments of Embodiments 1, 2, 3 4 or 5, the nucleic acid is mRNA, and the mRNA to lipid ratio in the LNP (i.e., N/P, were N represents the moles of cationic lipid and P represents the moles of phosphate present as part of the nucleic In an embodiment, the transfer vehicle comprises a lipid or an ionizable lipid described in US patent publication number 20190314524.

Some embodiments of the present invention provide nucleic acid-lipid nanoparticle compositions comprising one or more of the novel cationic lipids described herein as structures listed in Table 10, that provide increased activity of the nucleic acid and improved tolerability of the compositions in vivo.

In one embodiment, an ionizable lipid has the following structure (XII):

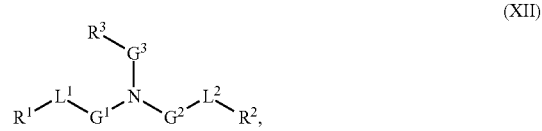

or a pharmaceutically acceptable salt, tautomer, prodrug or stereoisomer thereof, wherein:

one of $L^1$ or $L^2$ is —O(C=O)—, —(C=O)O—, —C(=O)—, —O—, —S(O)$_x$—, —S—S—, —C(=O)S—, —SC(=O)—, —NR$^a$C(=O)—, —C(=O)NR$^a$—, —NR$^a$C(=O)NR$^a$—, —OC(=O)NR$^a$— or —NR$^a$C(=O)O—, and the other of $L^1$ or $L^2$ is —O(C=O)—, —(C=O)O—, —C(=O)—, —O—, —S(O)$_x$—, —S—S—, —C(=O)S—, —SC(=O)—, —NR$^a$C(=O)—, —C(=O)NR$^a$—, —NR$^a$C(=O)NR$^a$—, —OC(=O)NR$^a$— or —NR$^a$C(=O)O— or a direct bond;

$G^1$ and $G^2$ are each independently unsubstituted $C_1$-$C_{12}$ alkylene or $C_1$-$C_{12}$ alkenylene;

$G^3$ is $C_1$-$C_{24}$ alkylene, $C_1$-$C_{24}$ alkenylene, $C_3$-$C_8$ cycloalkylene, $C_3$-$C_8$ cycloalkenylene;

$R^a$ is H or $C_1$-$C_{12}$ alkyl;

$R^1$ and $R^2$ are each independently $C_6$-$C_{24}$ alkyl or $C_6$-$C_{24}$ alkenyl;

$R^3$ is H, OR$^5$, CN, —C(=O)OR$^4$, —OC(=O)R$^4$ or —NR$^5$C(=O)R$^4$;

$R^4$ is $C_1$-$C_{12}$ alkyl;

$R^5$ is H or $C_1$-$C_6$ alkyl; and x is 0, 1 or 2.

In some embodiments, an ionizable lipid has one of the following structures (XIIA) or (XIIB):

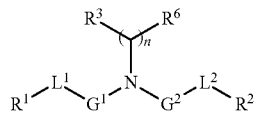
(XIIA)

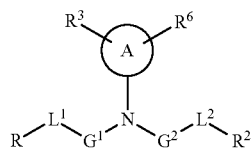
(XIIB)

wherein:
A is a 3 to 8-membered cycloalkyl or cycloalkylene ring;
$R^6$ is, at each occurrence, independently H, OH or $C_1$-$C_{24}$ alkyl; and
n is an integer ranging from 1 to 15.

In some embodiments, the ionizable lipid has structure (XIIA), and in other embodiments, the ionizable lipid has structure (XIIB).

In other embodiments, an ionizable lipid has one of the following structures (XIIC) or (XIID):

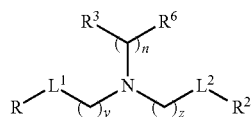
(XIIC)

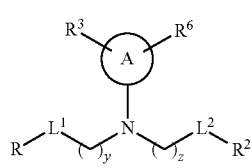
(XIID)

wherein y and z are each independently integers ranging from 1 to 12.

In some embodiments, one of $L^1$ or $L^2$ is —O(C=O)—. For example, in some embodiments each of $L^1$ and $L^2$ are —O(C=O)—. In some different embodiments of any of the foregoing, $L^1$ and $L^2$ are each independently —(C=O)O— or —O(C=O)—. For example, in some embodiments each of $L^1$ and $L^2$ is —(C=O)O—.

In some embodiments, an ionizable lipid has one of the following structures (XIIE) or (XIIF):

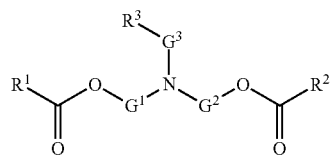
(XIIE)

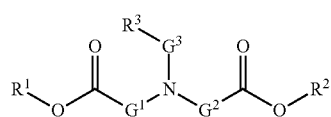
(XIIF)

In some embodiments, an ionizable lipid has one of the following structures (XIIG), (XIIH), (XIII), or (XIIJ):

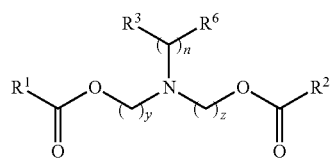
(XIIG)

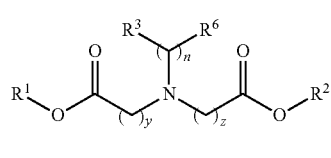
(XIIH)

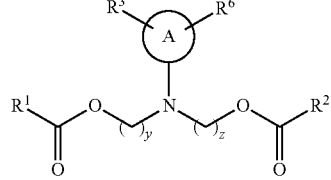
(XIII)

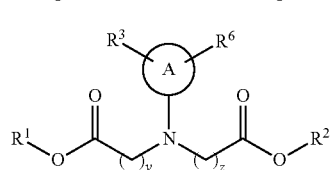
(XIIJ)

In some embodiments, n is an integer ranging from 2 to 12, for example from 2 to 8 or from 2 to 4. For example, in some embodiments, n is 3, 4, 5 or 6. In some embodiments, n is 3. In some embodiments, n is 4. In some embodiments, n is 5. In some embodiments, n is 6.

In some embodiments, y and z are each independently an integer ranging from 2 to 10. For example, in some embodiments, y and z are each independently an integer ranging from 4 to 9 or from 4 to 6.

In some embodiments, $R^6$ is H. In other embodiments, $R^6$ is $C_1$-$C_{24}$ alkyl. In other embodiments, $R^6$ is OH.

In some embodiments, G³ is unsubstituted. In other embodiments, G³ is substituted. In various different embodiments, G³ is linear $C_1$-$C_{24}$ alkylene or linear $C_1$-$C_{24}$ alkenylene.

In some embodiments, $R^1$ or $R^2$, or both, is $C_6$-$C_{24}$ alkenyl. For example, in some embodiments, $R^1$ and $R^2$ each, independently have the following structure:

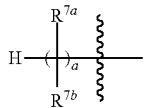

wherein:

$R^{7a}$ and $R^{7b}$ are, at each occurrence, independently H or $C_1$-$C_{12}$ alkyl; and a is an integer from 2 to 12, wherein $R^{7a}$, $R^{7b}$ and a are each selected such that $R^1$ and $R^2$ each independently comprise from 6 to 20 carbon atoms.

In some embodiments, a is an integer ranging from 5 to 9 or from 8 to 12.

In some embodiments, at least one occurrence of $R^{7a}$ is H. For example, in some embodiments, $R^{7a}$ is H at each occurrence. In other different embodiments, at least one occurrence of $R^{7b}$ is $C_1$-$C_8$ alkyl. For example, in some embodiments, $C_1$-$C_8$ alkyl is methyl, ethyl, n-propyl, iso-propyl, n-butyl, iso-butyl, tert-butyl, n-hexyl or n-octyl.

In different embodiments, $R^1$ or $R^2$, or both, has one of the following structures:

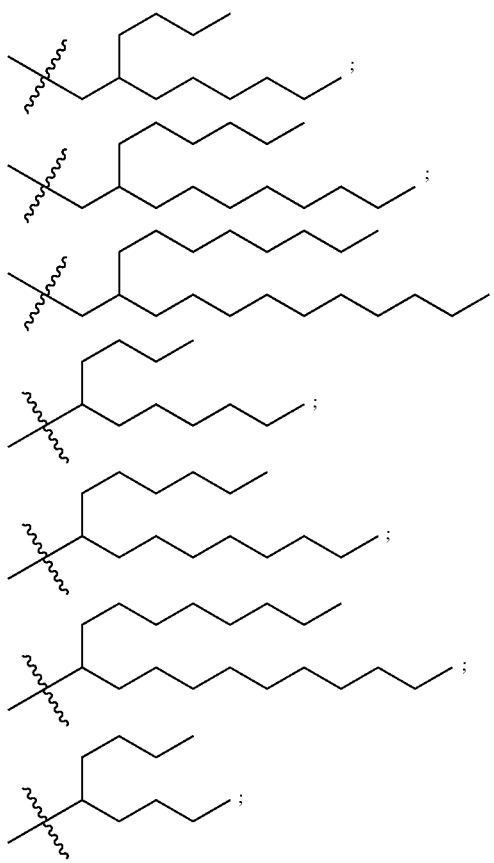

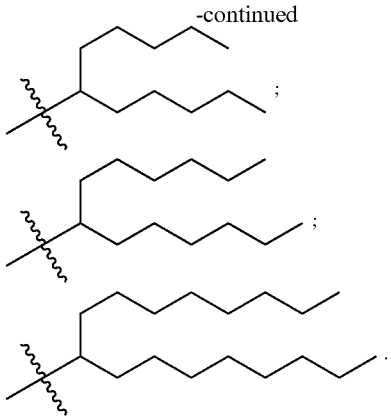

In some embodiments, $R^3$ is —OH, —CN, —C(=O)OR⁴, —OC(=O)R⁴ or —NHC(=O)R⁴. In some embodiments, $R^4$ is methyl or ethyl.

In some embodiments, an ionizable lipid is a compound of Formula (1):

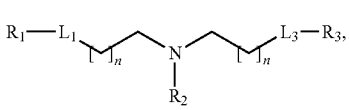

Formula (1)

wherein:

each n is independently 1, 2, 3, 4, 5, 6, 7, 8, 9, 10, 11, 12, 13, 14, or 15; and $L^1$ and $L^3$ are each independently —OC(O)—* or —C(O)O—*, wherein "*" indicates the attachment point to $R_1$ or $R_3$;

$R_1$ and $R_3$ are each independently a linear or branched $C_9$-$C_{20}$ alkyl or $C_9$-$C_{20}$ alkenyl, optionally substituted by one or more substituents selected from oxo, halo, hydroxy, cyano, alkyl, alkenyl, aldehyde, heterocyclylalkyl, hydroxyalkyl, dihydroxyalkyl, hydroxyalkylaminoalkyl, aminoalkyl, alkylaminoalkyl, dialkylaminoalkyl, (heterocyclyl)(alkyl)aminoalkyl, heterocyclyl, heteroaryl, alkylheteroaryl, alkynyl, alkoxy, amino, dialkylamino, aminoalkylcarbonylamino, aminocarbonylalkylamino, (aminocarbonylalkyl)(alkyl)amino, alkenylcarbonylamino, hydroxycarbonyl, alkyloxycarbonyl, aminocarbonyl, aminoalkylaminocarbonyl, alkylaminoalkylaminocarbonyl, dialkylaminoalkylaminocarbonyl, heterocyclylalkylaminocarbonyl, (alkylaminoalkyl)(alkyl)aminocarbonyl, alkylaminoalkylcarbonyl, dialkylaminoalkylcarbonyl, heterocyclylcarbonyl, alkenylcarbonyl, alkynylcarbonyl, alkylsulfoxide, alkylsulfoxidealkyl, alkylsulfonyl, and alkylsulfonealkyl.

In some embodiments, $R_1$ and $R_3$ are the same. In some embodiments, $R_1$ and $R_3$ are different.

In some embodiments, $R_1$ and $R_3$ are each independently a branched saturated $C_9$-$C_{20}$ alkyl. In some embodiments, one of $R_1$ and $R_3$ is a branched saturated $C_9$-$C_{20}$ alkyl, and the other is an unbranched saturated $C_9$-$C_{20}$ alkyl. In some embodiments, $R_1$ and $R_3$ are each independently selected from a group consisting of:

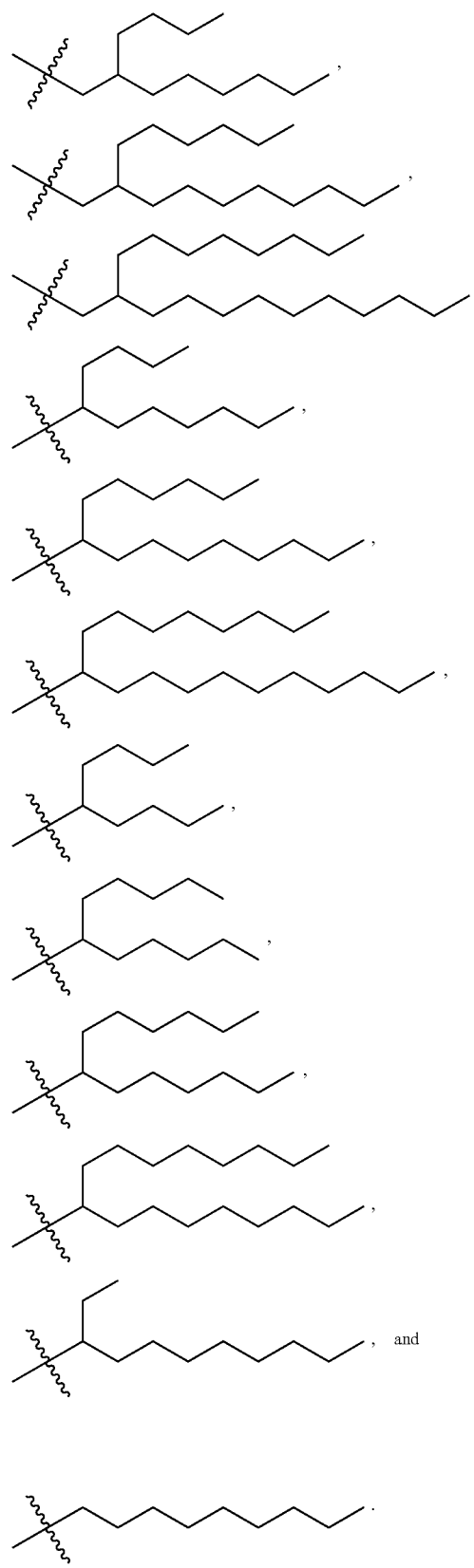
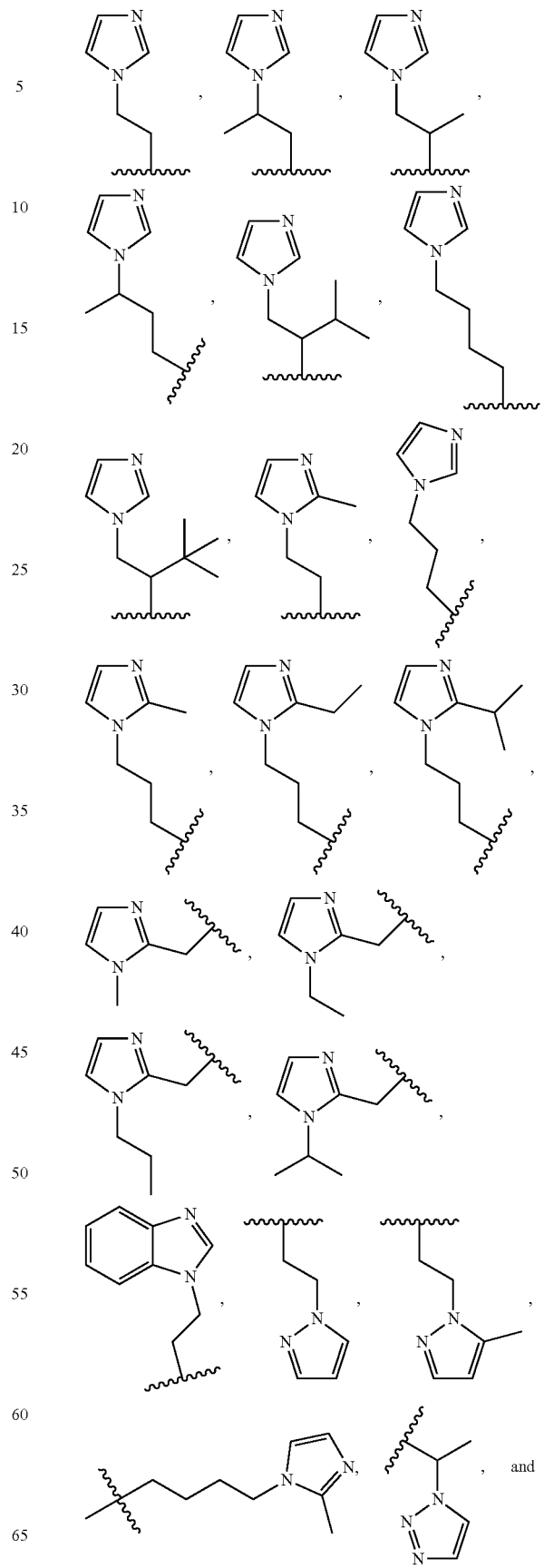
In various embodiments, $R_2$ is selected from a group consisting of:

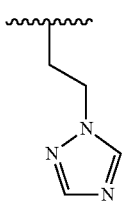

In some embodiments, $R_2$ may be as described in International Pat. Pub. No. WO2019/152848 A1, which is incorporated herein by reference in its entirety.

In some embodiments, an ionizable lipid is a compound of Formula (1-1) or Formula (1-2):

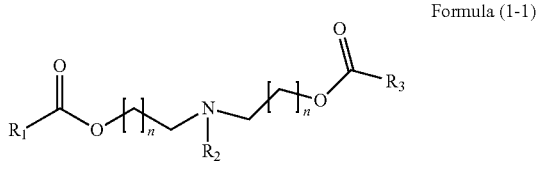

Formula (1-1)

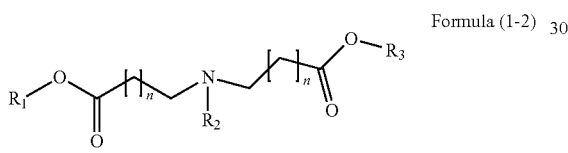

Formula (1-2)

wherein n, $R_1$, $R_2$, and $R_3$ are as defined in Formula (1).

Preparation methods for the above compounds and compositions are described herein below and/or known in the art.

It will be appreciated by those skilled in the art that in the process described herein the functional groups of intermediate compounds may need to be protected by suitable protecting groups. Such functional groups include, e.g., hydroxyl, amino, mercapto, and carboxylic acid. Suitable protecting groups for hydroxyl include, e.g., trialkylsilyl or diarylalkylsilyl (for example, t-butyldimethylsilyl, t-butyldiphenylsilyl or trimethylsilyl), tetrahydropyranyl, benzyl, and the like. Suitable protecting groups for amino, amidino, and guanidino include, e.g., t-butoxycarbonyl, benzyloxycarbonyl, and the like. Suitable protecting groups for mercapto include, e.g., —C(O)—R" (where R" is alkyl, aryl, or arylalkyl), p-methoxybenzyl, trityl, and the like. Suitable protecting groups for carboxylic acid include, e.g., alkyl, aryl, or arylalkyl esters. Protecting groups may be added or removed in accordance with standard techniques, which are known to one skilled in the art and as described herein. The use of protecting groups is described in detail in, e.g., Green, T. W. and P. G. M. Wutz, Protective Groups in Organic Synthesis (1999), 3rd Ed., Wiley. As one of skill in the art would appreciate, the protecting group may also be a polymer resin such as a Wang resin, Rink resin, or a 2-chlorotrityl-chloride resin.

It will also be appreciated by those skilled in the art, although such protected derivatives of compounds of this invention may not possess pharmacological activity as such, they may be administered to a mammal and thereafter metabolized in the body to form compounds of the invention which are pharmacologically active. Such derivatives may therefore be described as prodrugs. All prodrugs of compounds of this invention are included within the scope of the invention.

Furthermore, all compounds of the invention which exist in free base or acid form can be converted to their pharmaceutically acceptable salts by treatment with the appropriate inorganic or organic base or acid by methods known to one skilled in the art. Salts of the compounds of the invention can also be converted to their free base or acid form by standard techniques.

The following reaction scheme illustrates an exemplary method to make compounds of Formula (1):

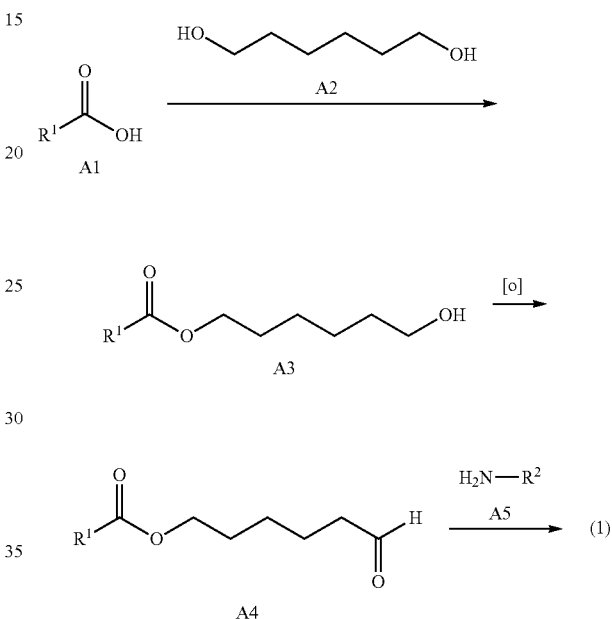

A1 are purchased or prepared according to methods known in the art. Reaction of A1 with diol A2 under appropriate condensation conditions (e.g., DCC) yields ester/alcohol A3, which can then be oxidized (e.g., with PCC) to aldehyde A4. Reaction of A4 with amine A5 under reductive amination conditions yields a compound of Formula (1).

The following reaction scheme illustrates a second exemplary method to make compounds of Formula (1), wherein $R_1$ and $R_3$ are the same:

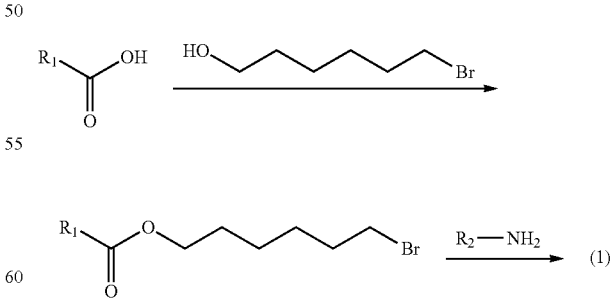

Modifications to the above reaction scheme, such as using protecting groups, may yield compounds wherein $R_1$ and $R_3$ are different. The use of protecting groups, as well as other modification methods, to the above reaction scheme will be readily apparent to one of ordinary skill in the art.

It is understood that one skilled in the art may be able to make these compounds by similar methods or by combining other methods known to one skilled in the art. It is also understood that one skilled in the art would be able to make other compounds of Formula (1) not specifically illustrated herein by using the appropriate starting materials and modifying the parameters of the synthesis. In general, starting materials may be obtained from sources such as Sigma Aldrich, Lancaster Synthesis, Inc., Maybridge, Matrix Scientific, TCI, and Fluorochem USA, etc. or synthesized according to sources known to those skilled in the art (see, e.g., Advanced Organic Chemistry: Reactions, Mechanisms, and Structure, 5th edition (Wiley, December 2000)) or prepared as described in this invention.

In some embodiments, an ionizable lipid is a compound of Formula (2):

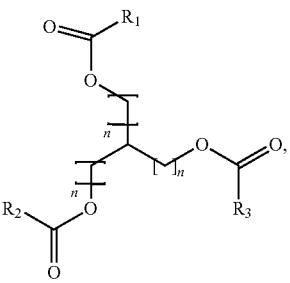

Formual (2)

wherein each n is independently 1, 2, 3, 4, 5, 6, 7, 8, 9, 10, 11, 12, 13, 14, or 15.

In some embodiments, as used in Formula (2), $R_1$ and $R_2$ are as defined in Formula (1).

In some embodiments, as used in Formula (2), $R_1$ and $R_2$ are each independently selected from a group consisting of:

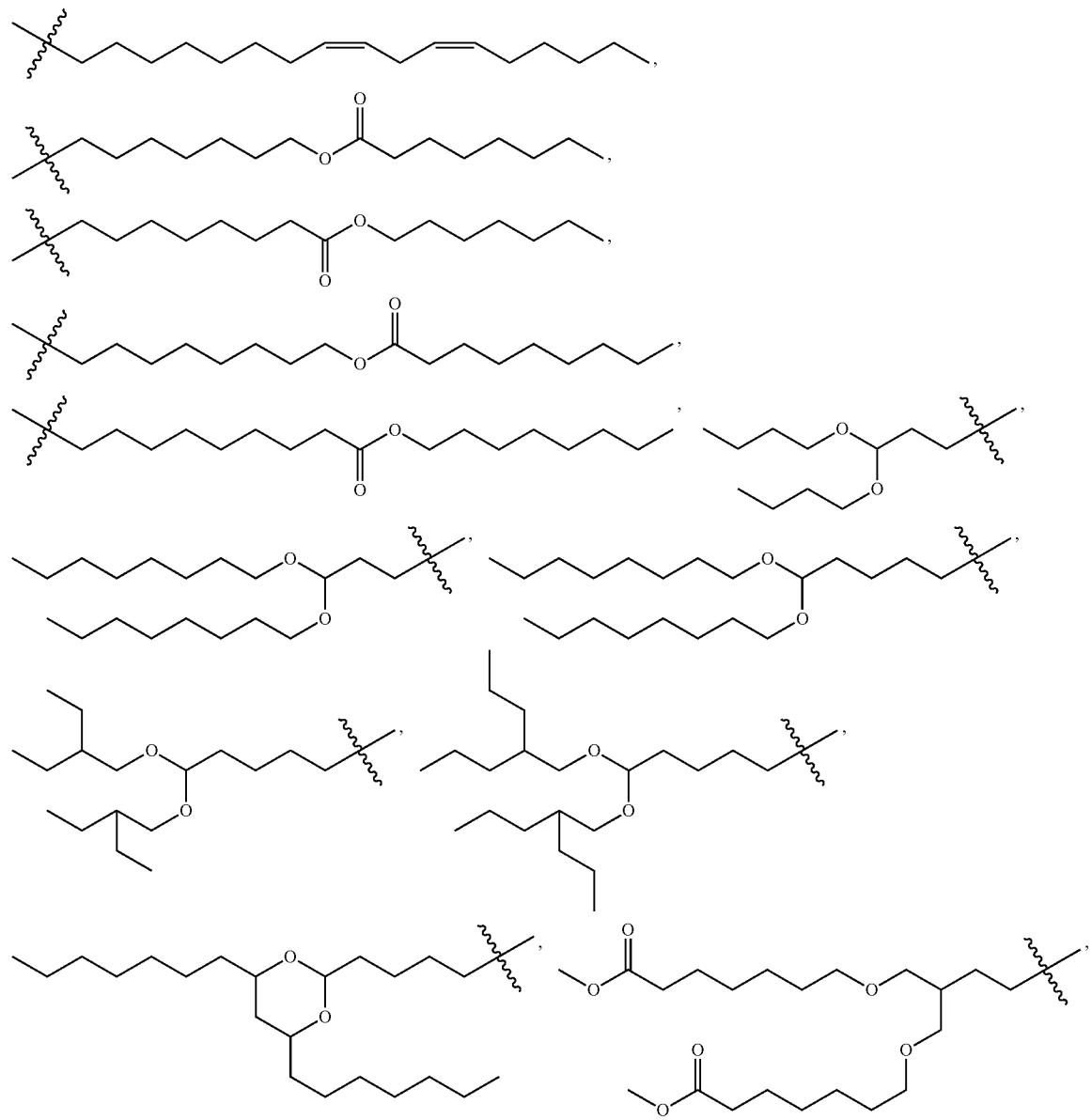

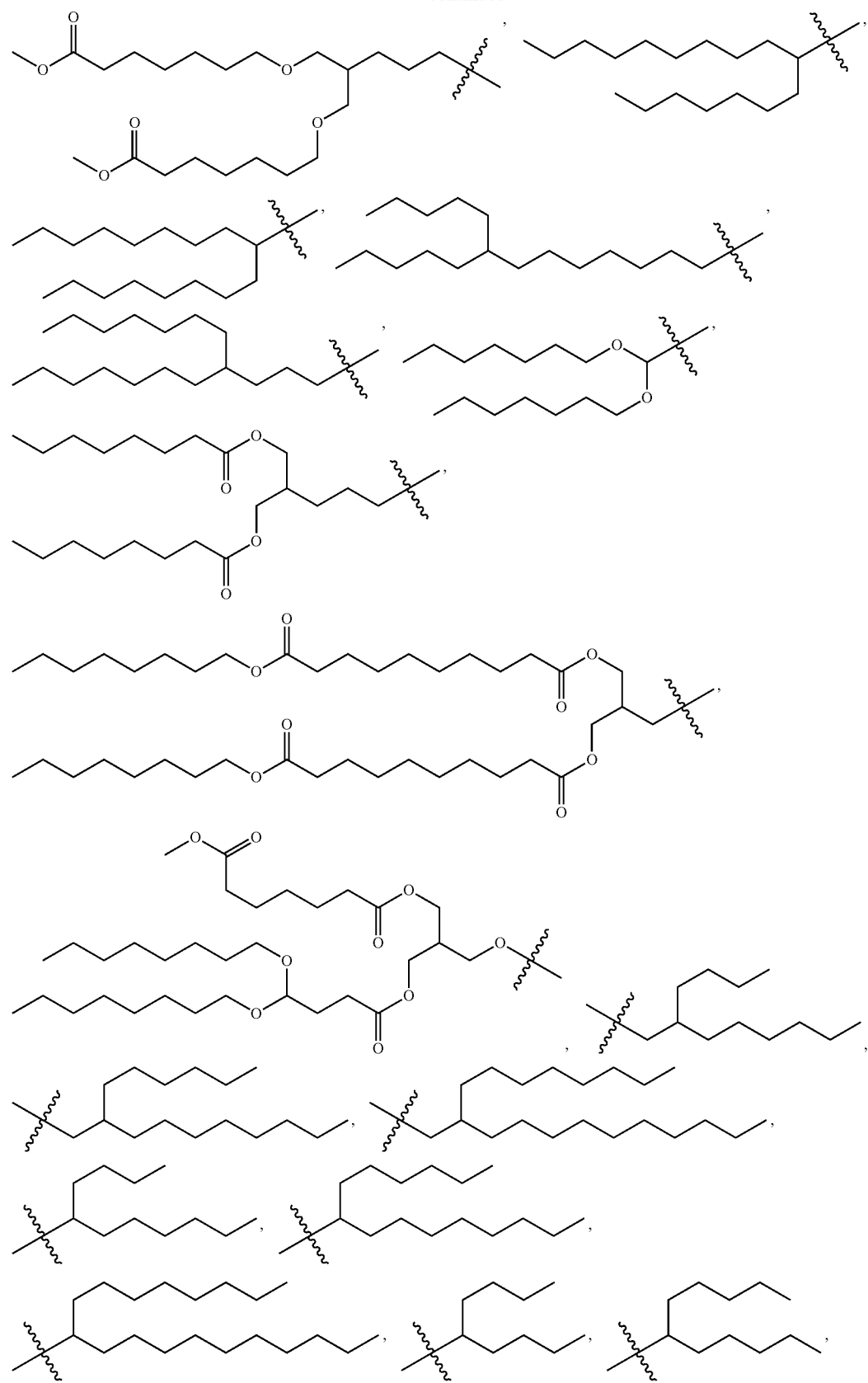

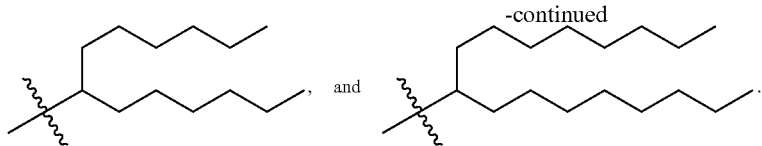

In some embodiments, $R_1$ and/or $R_2$ as used in Formula (2) may be as described in International Pat. Pub. No. WO2015/095340 A1, which is incorporated herein by reference in its entirety. In some embodiments, $R_1$ as used in Formula (2) may be as described in International Pat. Pub. No. WO2019/152557 A1, which is incorporated herein by reference in its entirety.

In some embodiments, as used in Formula (2), $R_3$ is selected from a group consisting of.

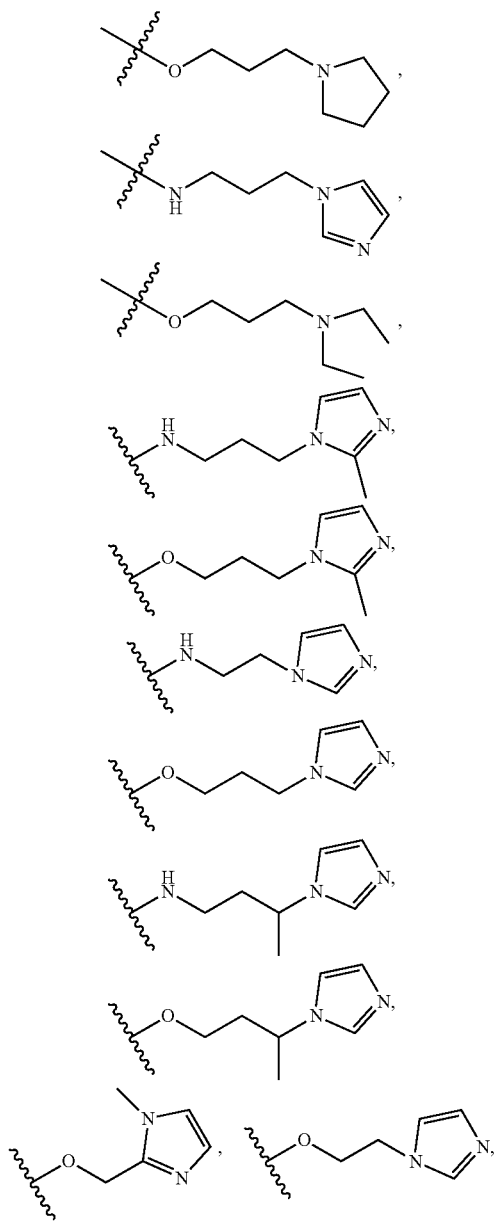

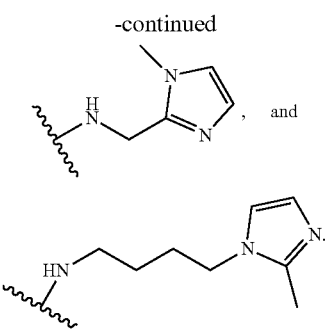

In some embodiments, an ionizable lipid is a compound of Formula (3)

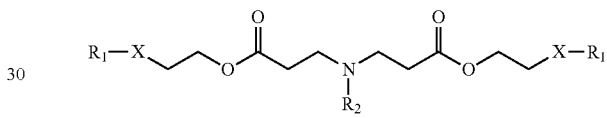

wherein X is selected from —O—, —S—, or —OC(O)—*, wherein * indicates the attachment point to $R_1$.

In some embodiments, an ionizable lipid is a compound of Formula (3-1):

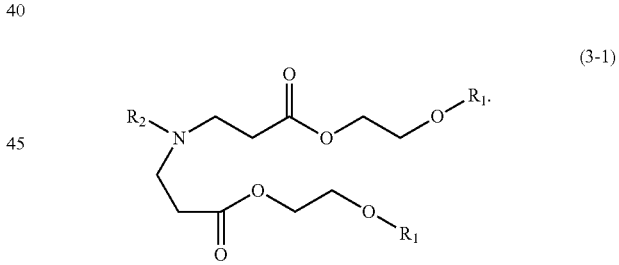

(3-1)

In some embodiments, an ionizable lipid is a compound of Formula (3-2):

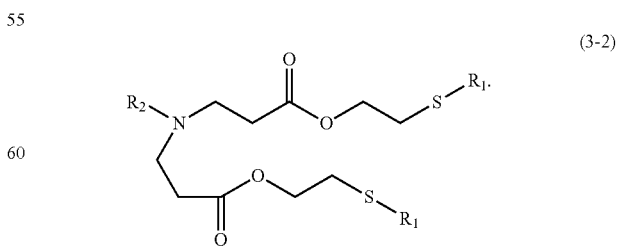

(3-2)

In some embodiments, an ionizable lipid is a compound of Formula (3-3):

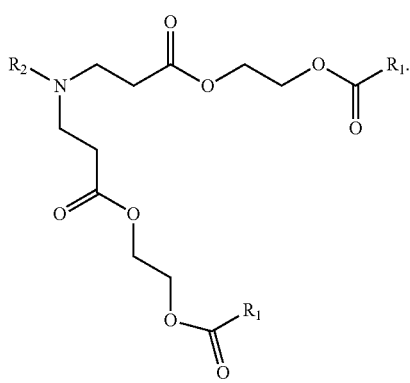
In some embodiments, as used in Formula (3-1), (3-2), or (3-3), each $R_1$ is independently a branched saturated $C_9$-$C_{20}$ alkyl. In some embodiments, each $R_1$ is independently selected from a group consisting of:
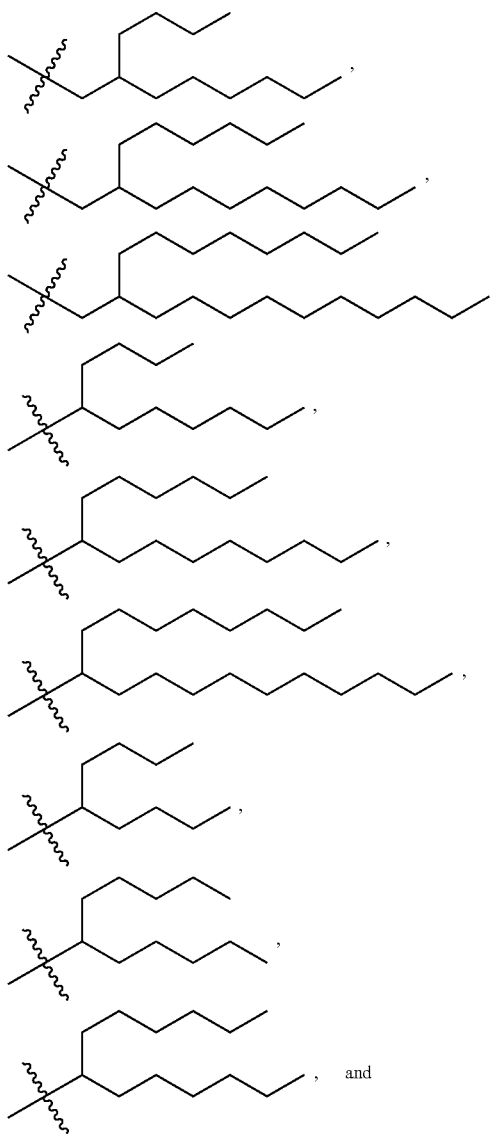
and
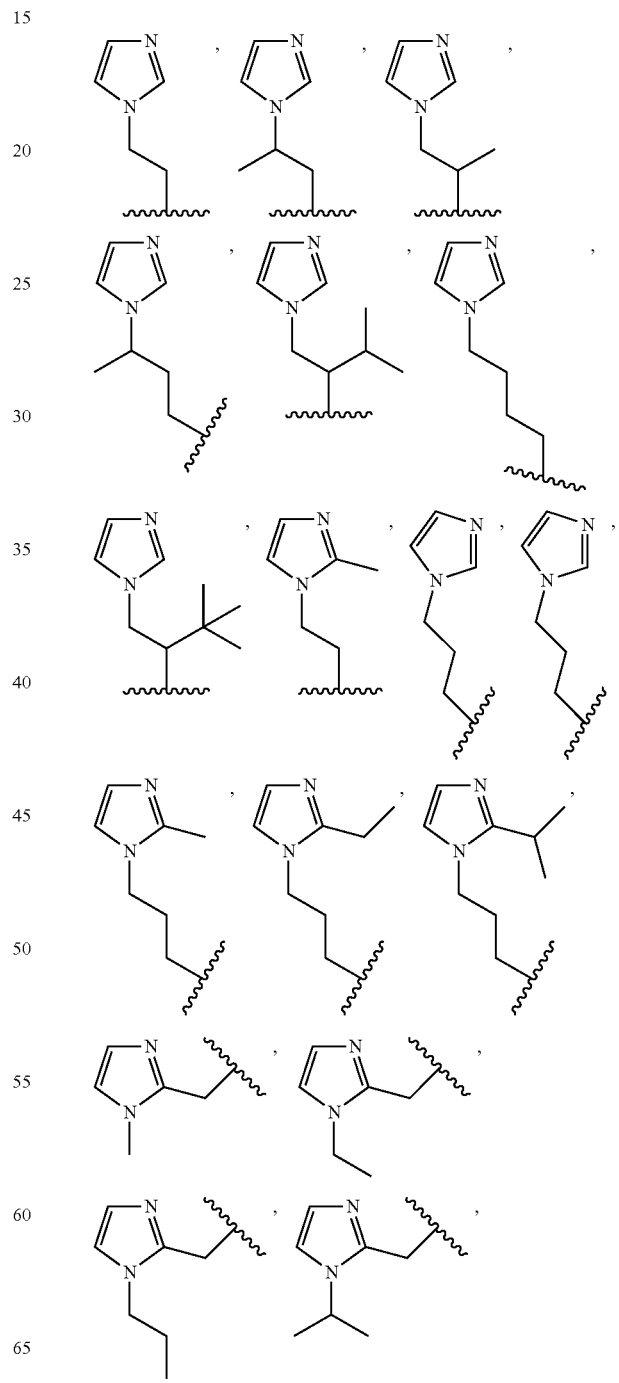
In some embodiments, each $R_1$ in Formula (3-1), (3-2), or (3-3) are the same.
In some embodiments, as used in Formula (3-1), (3-2), or (3-3), $R_2$ is selected from a group consisting of:

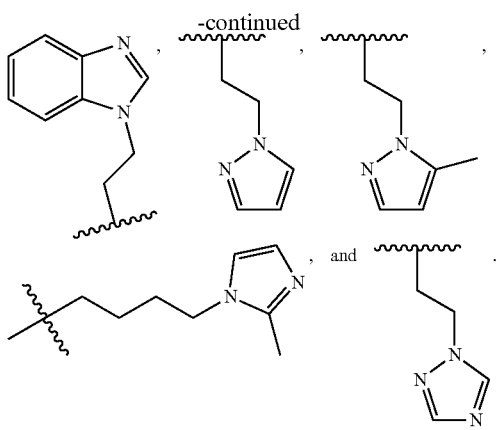

In some embodiments, $R_2$ as used in Formula (3-1), (3-2), or (3-3) may be as described in International Pat. Pub. No. WO2019/152848A1, which is incorporated herein by reference in its entirety.

In some embodiments, an ionizable lipid is a compound of Formula (5):

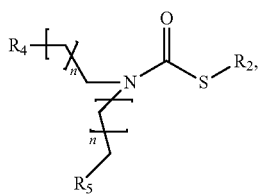

wherein:
each n is independently 1, 2, 3, 4, 5, 6, 7, 8, 9, 10, 11, 12, 13, 14, or 15; and
$R_2$ is as defined in Formula (1).

In some embodiments, as used in Formula (5), $R_4$ and $R_5$ are defined as $R_1$ and $R_3$, respectively, in Formula (1). In some embodiments, as used in Formula (5), $R_4$ and $R_5$ may be as described in International Pat. Pub. No. WO2019/191780 A1, which is incorporated herein by reference in its entirety.

In some embodiments, an ionizable lipid is a compound of Formula (6):

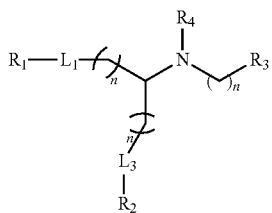

Formula (6)

wherein:
each n is independently an integer from 0-15;
$L^1$ and $L^3$ are each independently —OC(O)—* or —C(O)O—*, wherein "*" indicates the attachment point to $R_1$ or $R_3$;
$R_1$ and $R_2$ are each independently a linear or branched $C_9$-$C_{20}$ alkyl or $C_9$-$C_{20}$ alkenyl, optionally substituted by one or more substituents selected from a group consisting of oxo, halo, hydroxy, cyano, alkyl, alkenyl, aldehyde, heterocyclylalkyl, hydroxyalkyl, dihydroxyalkyl, hydroxyalkylaminoalkyl, aminoalkyl, alkylaminoalkyl, dialkylaminoalkyl, (heterocyclyl)(alkyl)aminoalkyl, heterocyclyl, heteroaryl, alkylheteroaryl, alkynyl, alkoxy, amino, dialkylamino, aminoalkylcarbonylamino, aminocarbonylalkylamino, (aminocarbonylalkyl)(alkyl)amino, alkenylcarbonylamino, hydroxycarbonyl, alkyloxycarbonyl, aminocarbonyl, aminoalkylaminocarbonyl, alkylaminoalkylaminocarbonyl, dialkylaminoalkylaminocarbonyl, heterocyclylalkylaminocarbonyl, (alkylaminoalkyl)(alkyl)aminocarbonyl, alkylaminoalkylcarbonyl, dialkylaminoalkylcarbonyl, heterocyclylcarbonyl, alkenylcarbonyl, alkynylcarbonyl, alkylsulfoxide, alkylsulfoxidealkyl, alkylsulfonyl, and alkylsulfonealkyl;

$R_3$ is selected from a group consisting of:

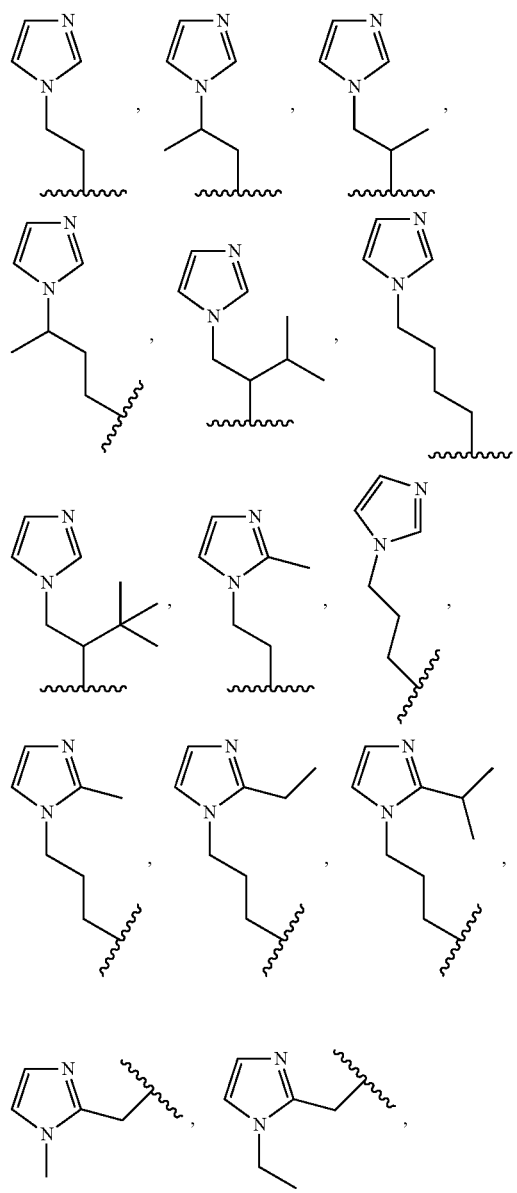

293
-continued
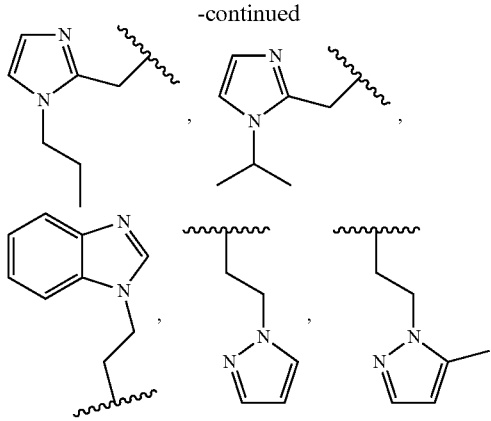
294
-continued
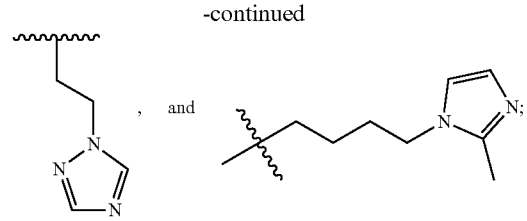
$R_4$ is a linear or branched $C_1$-$C_{15}$ alkyl or $C_1$-$C_{15}$ alkenyl.
In some embodiments, $R_1$ and $R_2$ are each independently selected from a group consisting of:
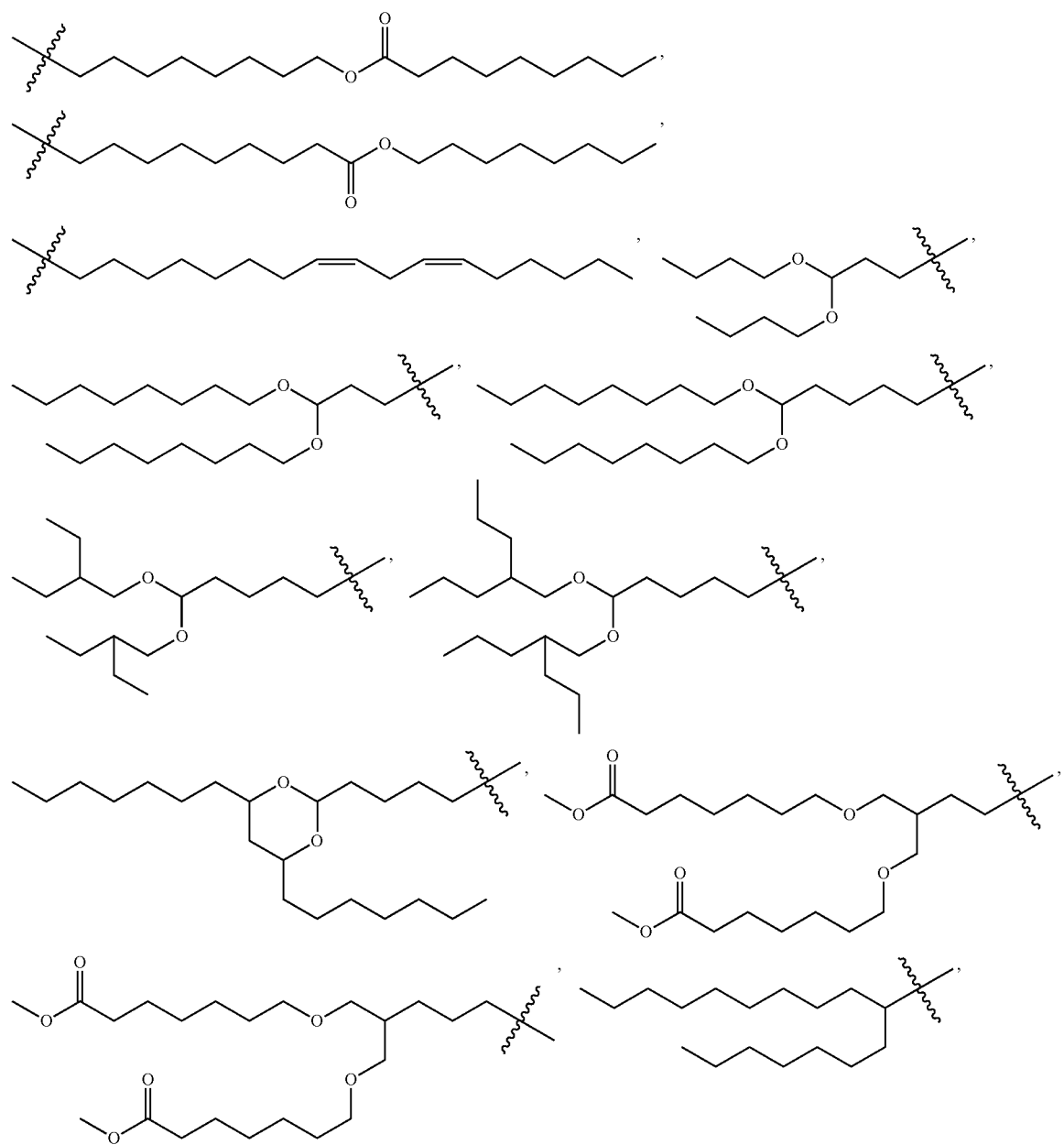

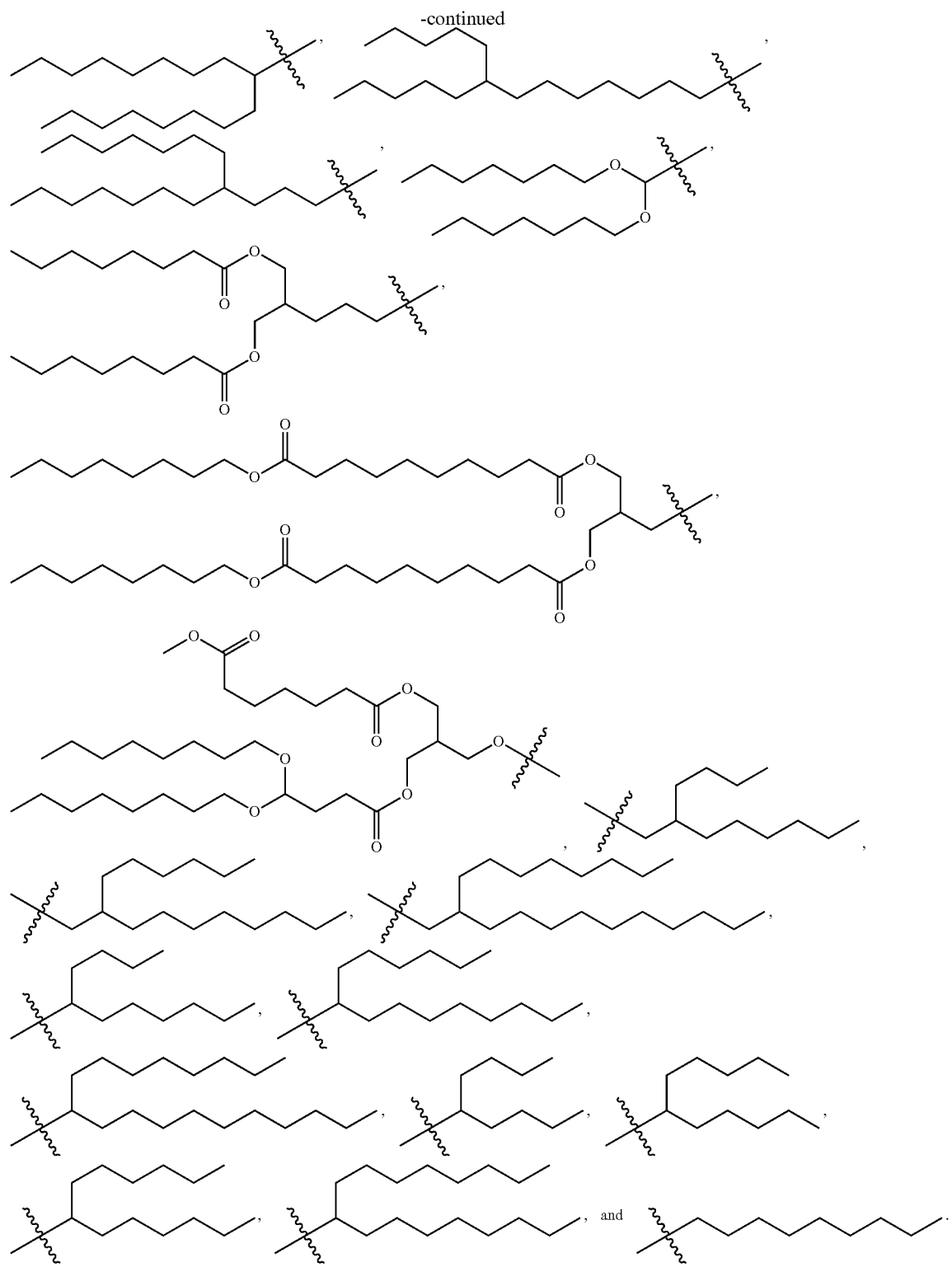

In some embodiments, $R_1$ and $R_2$ are the same. In some embodiments, $R_1$ and $R_2$ are different.

In some embodiments, an ionizable lipid of the disclosure is selected from Table 10a. In some embodiments, the ionizable lipid is Lipid 26 in Table 10a. In some embodiments, the ionizable lipid is Lipid 27 in Table 10a. In some embodiments, the ionizable lipid is Lipid 53 in Table 10a. In some embodiments, the ionizable lipid is Lipid 54 in Table 10a. In some embodiments, the ionizable lipid is Lipid 45 in Table 10a. In some embodiments, the ionizable lipid is Lipid 46 in Table 10a. In some embodiments, the ionizable lipid is Lipid 137 in Table 10a. In some embodiments, the ionizable lipid is Lipid 138 in Table 10a. In some embodiments, the ionizable lipid is Lipid 139 in Table 10a. In some embodiments, the ionizable lipid is Lipid 128 in Table 10a. In some embodiments, the ionizable lipid is Lipid 130 in Table 10a.
In some embodiments, an ionizable lipid of the disclosure is selected from the group consisting of:
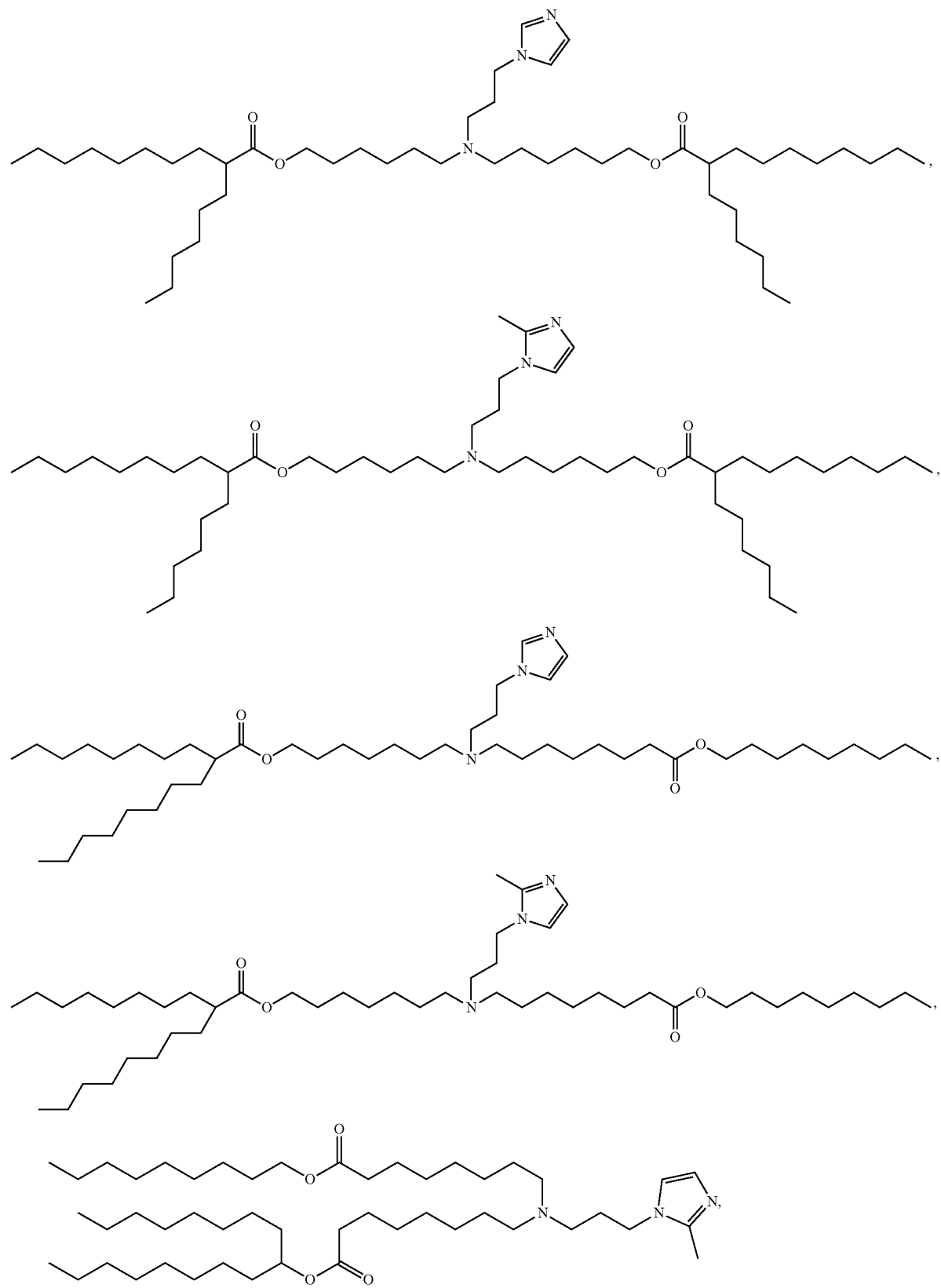

-continued
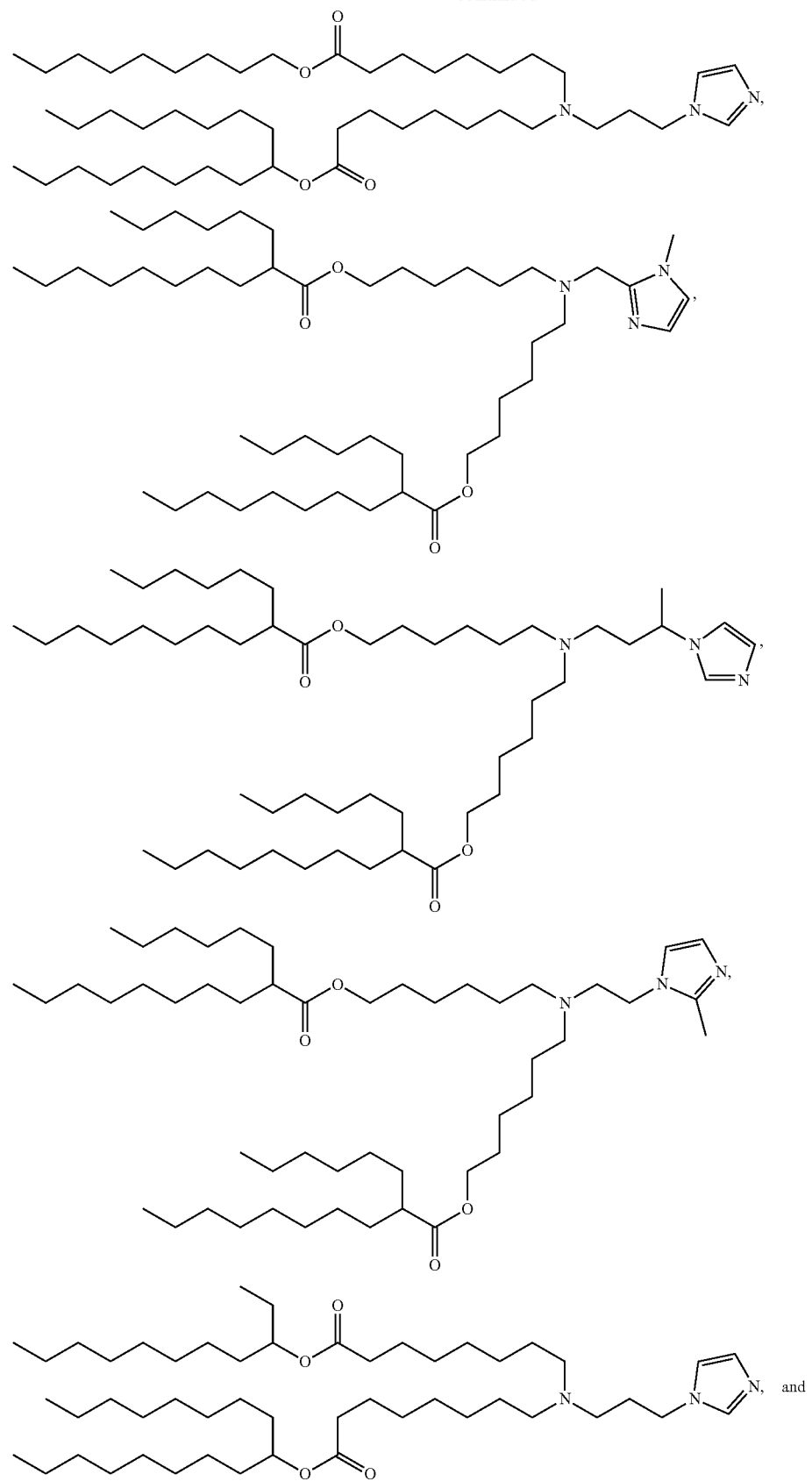

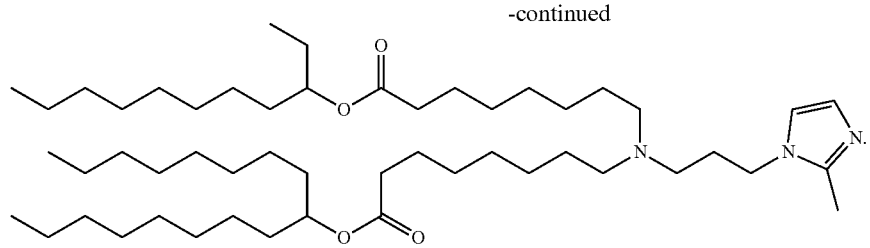
In some embodiments, an ionizable lipid of the disclosure is selected from the group consisting of:
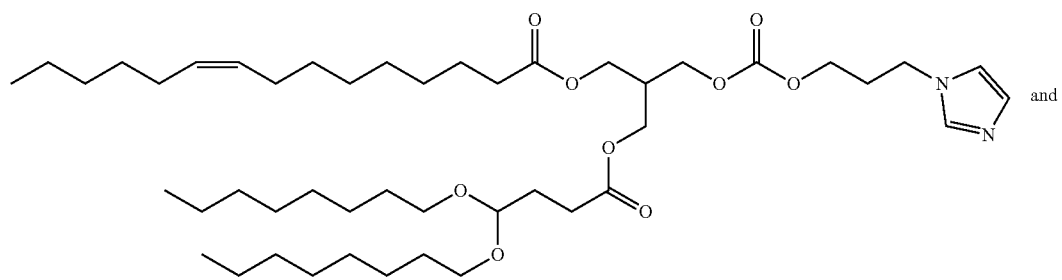 and
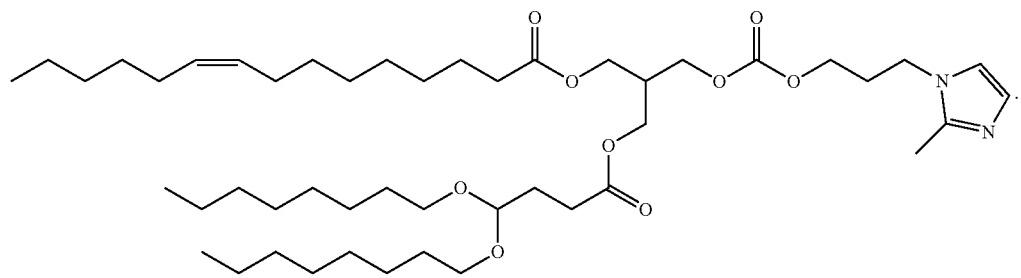
In some embodiments, an ionizable lipid of the disclosure is selected from the group consisting of:
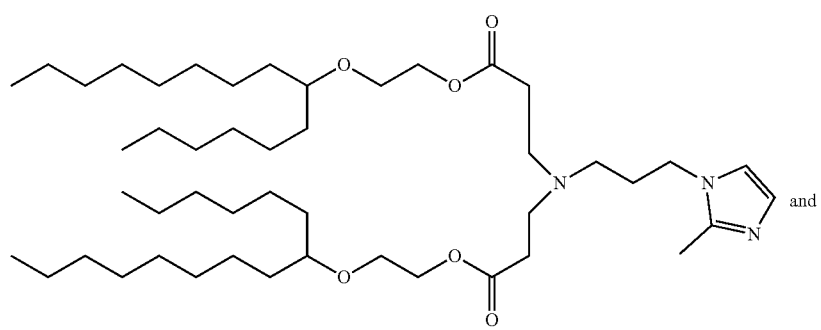 and

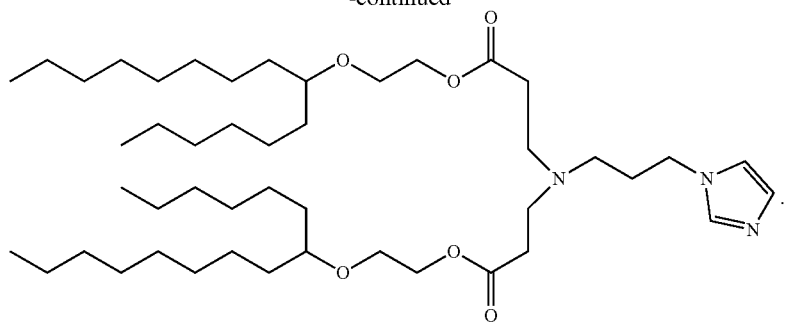
15
In some embodiments an ionizable lipid of the disclosure is selected from the group consisting of:
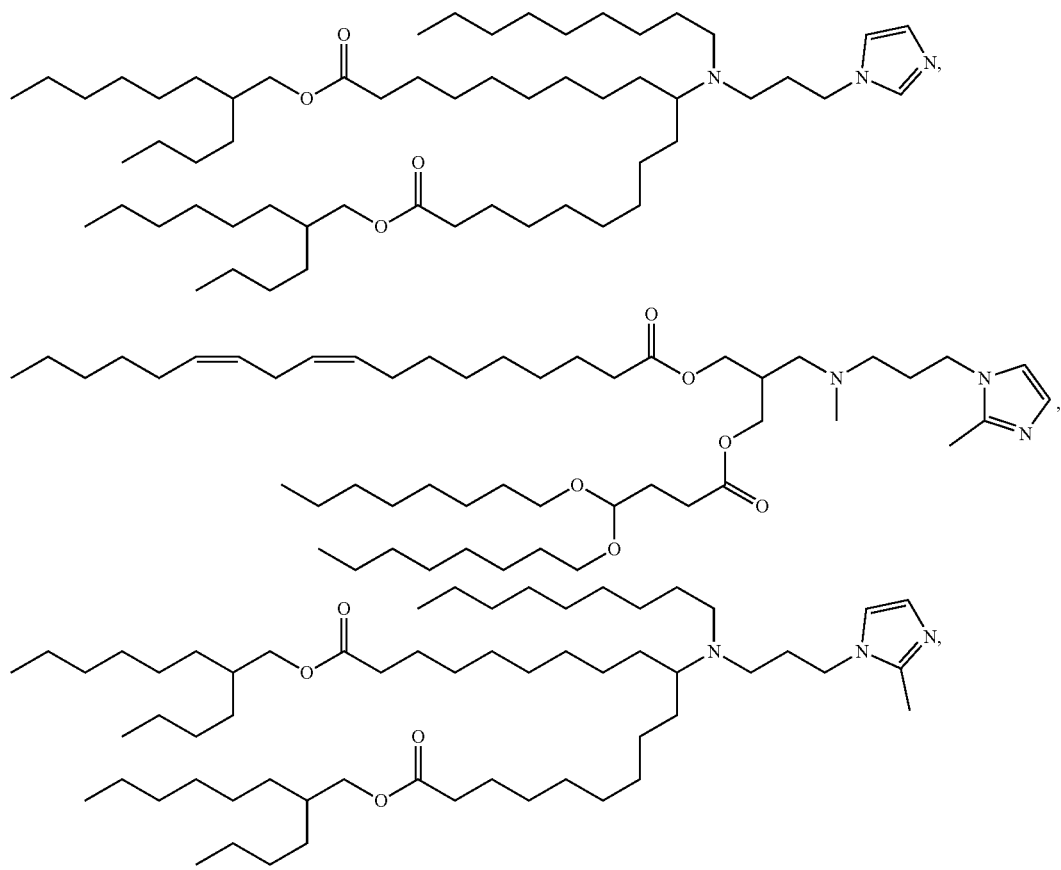
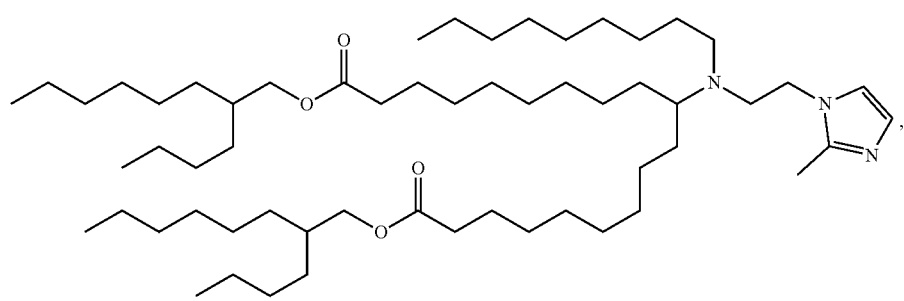

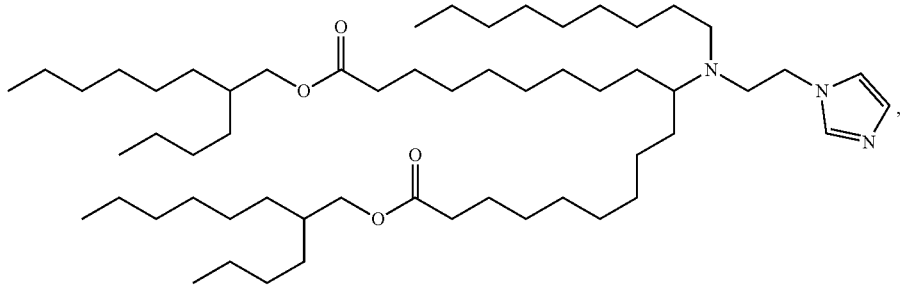
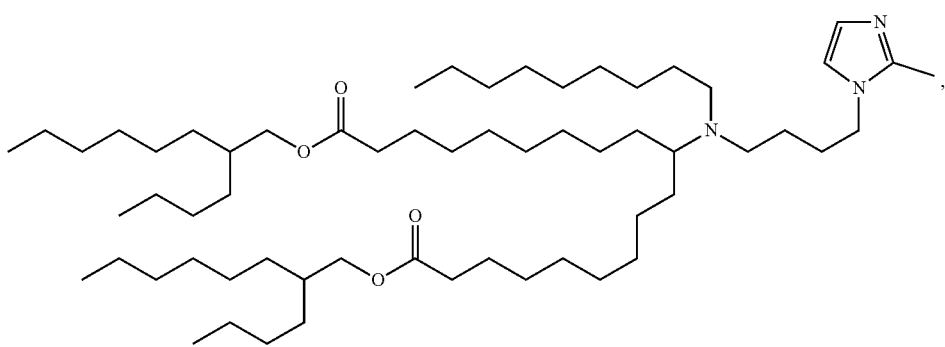
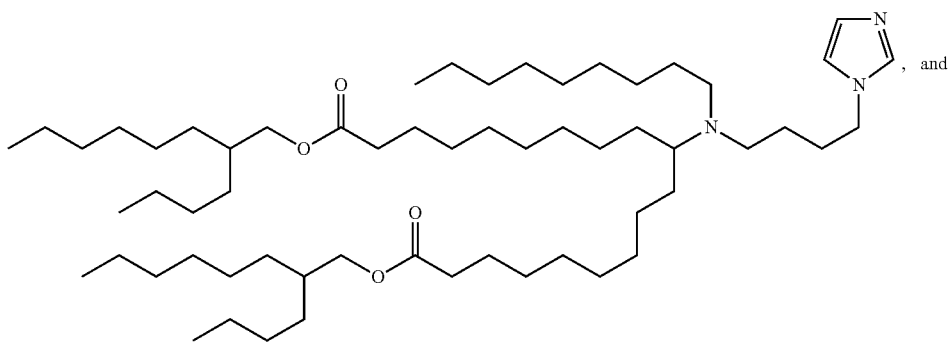
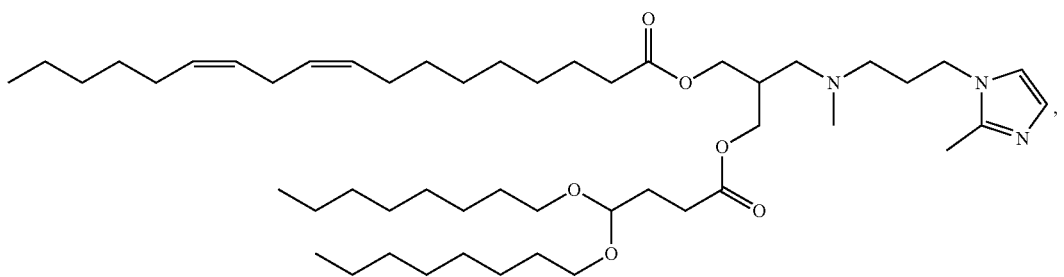

TABLE 10a
| Ionized lipid number | Structure |
|---|---|
| 1 | 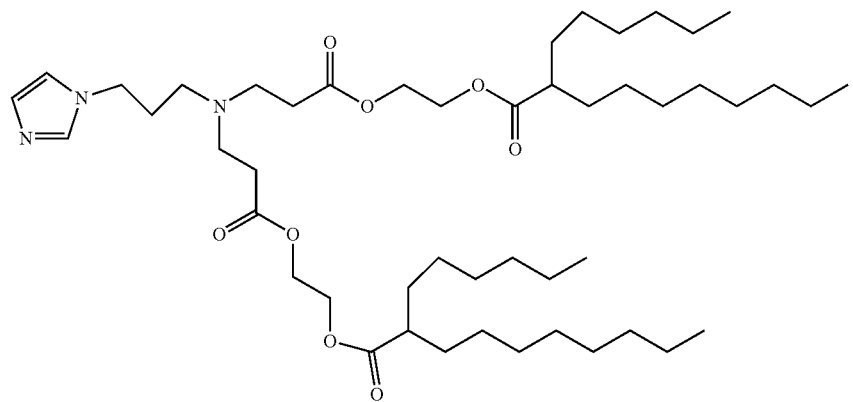 [SMILES: CCCCCCCCC(CCCCCC)C(=O)OCCOC(=O)CCN(CCCn1ccnc1)CCC(=O)OCCOC(=O)C(CCCCCC)CCCCCCCC] |
| 2 | 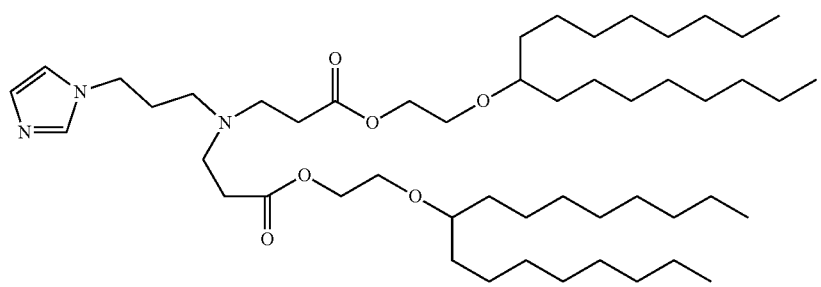 [SMILES: CCCCCCCCC(CCCCCCCC)OCCOC(=O)CCN(CCCn1ccnc1)CCC(=O)OCCOC(CCCCCCCC)CCCCCCCC] |
| 3 | 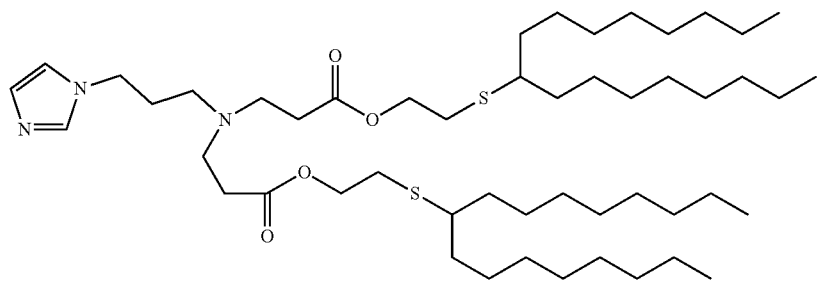 |
| 4 | 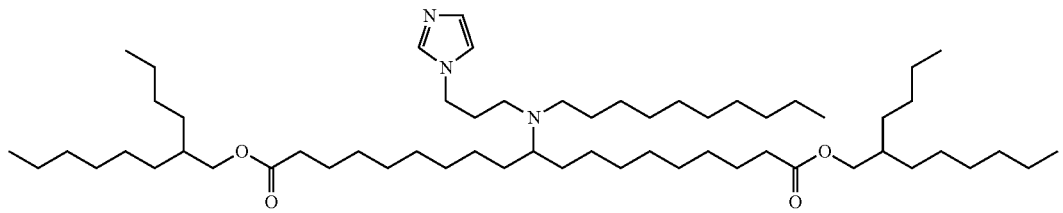 [SMILES: CCCCCCCCCCN(CCCn1ccnc1)C(CCCCCCCCC(=O)OCC(CCCC)CCCCCC)CCCCCCCCC(=O)OCC(CCCC)CCCCCC] |
| 5 | 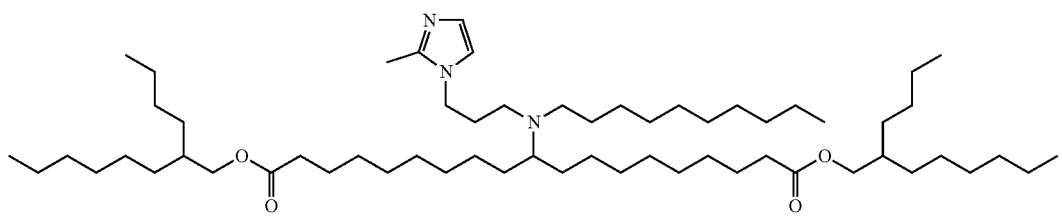 [SMILES: CCCCCCCCCCN(CCCn1ccnc1C)C(CCCCCCCCC(=O)OCC(CCCC)CCCCCC)CCCCCCCCC(=O)OCC(CCCC)CCCCCC] |

TABLE 10a-continued
| Ionized lipid number | Structure |
| --- | --- |
| 6 | 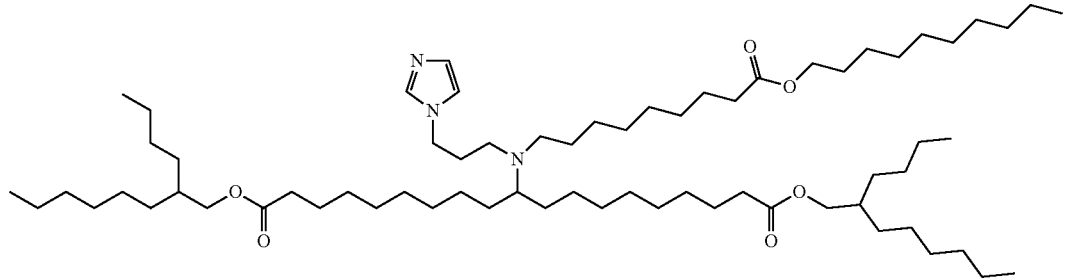 [SMILES: CCCCCCCCCCOC(=O)CCCCCCCCN(CCCn1ccnc1)C(CCCCCCCCC(=O)OCC(CCCC)CCCCCC)CCCCCCCCC(=O)OCC(CCCC)CCCCCC] |
| 7 | 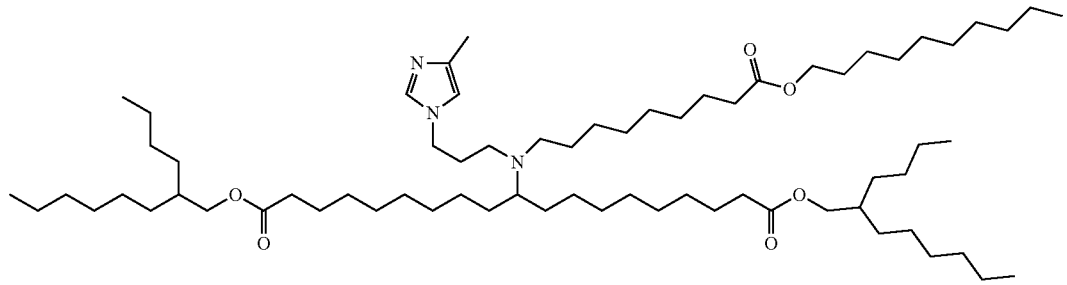 [SMILES: CCCCCCCCCCOC(=O)CCCCCCCCN(CCCn1cnc(C)c1)C(CCCCCCCCC(=O)OCC(CCCC)CCCCCC)CCCCCCCCC(=O)OCC(CCCC)CCCCCC] |
| 8 | 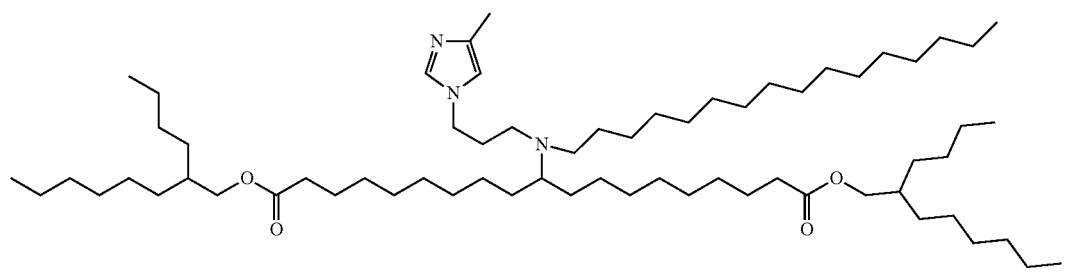 [SMILES: CCCCCCCCCCCCCCCCN(CCCn1cnc(C)c1)C(CCCCCCCCC(=O)OCC(CCCC)CCCCCC)CCCCCCCCC(=O)OCC(CCCC)CCCCCC] |
| 9 | 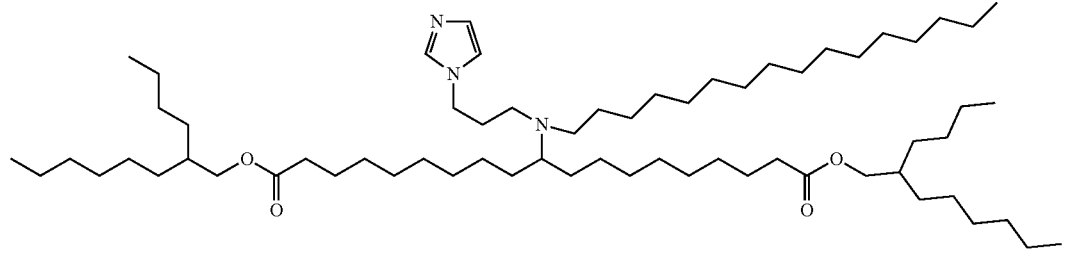 [SMILES: CCCCCCCCCCCCCCCCN(CCCn1ccnc1)C(CCCCCCCCC(=O)OCC(CCCC)CCCCCC)CCCCCCCCC(=O)OCC(CCCC)CCCCCC] |
| 10 | 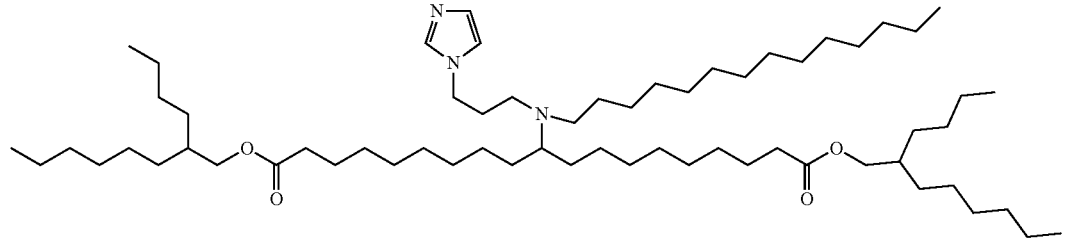 [SMILES: CCCCCCCCCCCCCCN(CCCn1ccnc1)C(CCCCCCCCC(=O)OCC(CCCC)CCCCCC)CCCCCCCCC(=O)OCC(CCCC)CCCCCC] |

TABLE 10a-continued
| Ionized lipid number | Structure |
|---|---|
| 11 | 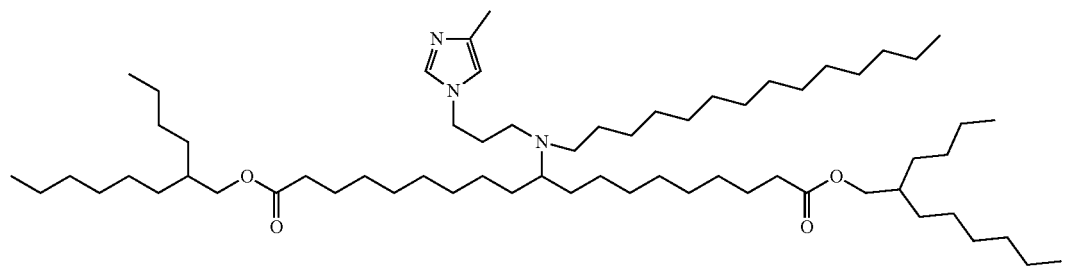 [SMILES: CCCCCCCCCCCCCCN(CCCn1cnc(C)c1)C(CCCCCCCCC(=O)OCC(CCCC)CCCCCC)CCCCCCCCC(=O)OCC(CCCC)CCCCCC] |
| 12 | 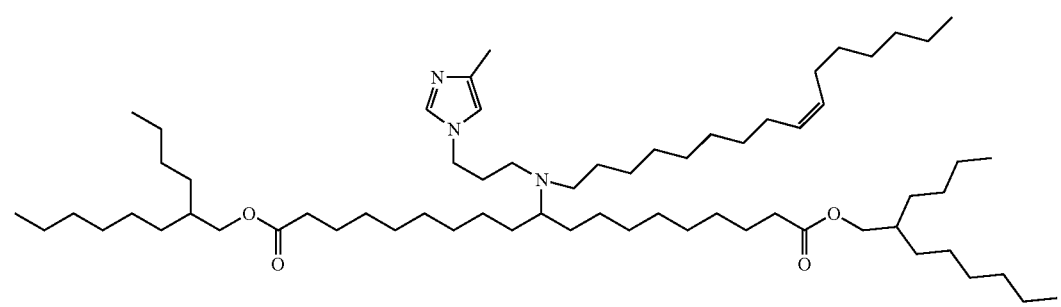 [SMILES: CCCCCC/C=C\CCCCCCCCN(CCCn1cnc(C)c1)C(CCCCCCCCC(=O)OCC(CCCC)CCCCCC)CCCCCCCCC(=O)OCC(CCCC)CCCCCC] |
| 13 | 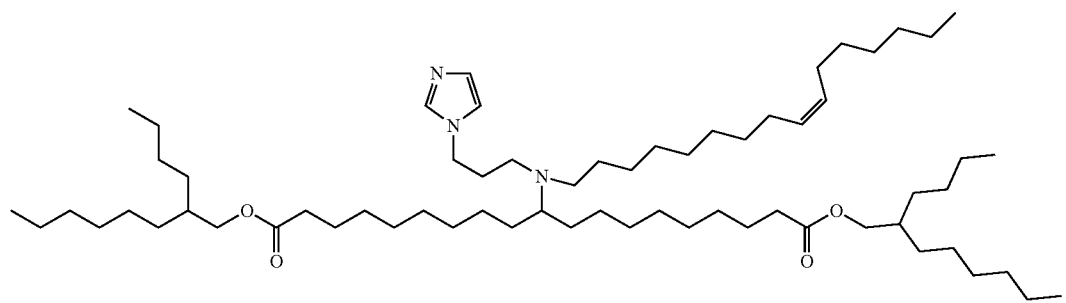 [SMILES: CCCCCC/C=C\CCCCCCCCN(CCCn1ccnc1)C(CCCCCCCCC(=O)OCC(CCCC)CCCCCC)CCCCCCCCC(=O)OCC(CCCC)CCCCCC] |
| 14 | 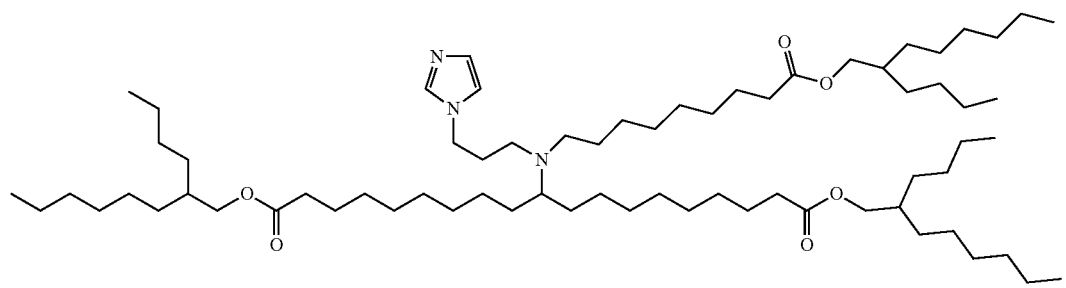 [SMILES: CCCCCCC(CCCC)COC(=O)CCCCCCCCC(CCCCCCCCC(=O)OCC(CCCC)CCCCCC)N(CCCCCCCCC(=O)OCC(CCCC)CCCCCC)CCCn1ccnc1] |
| 15 | 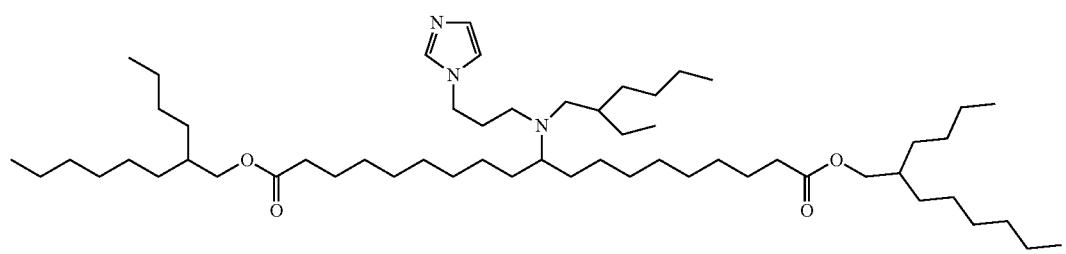 [SMILES: CCCCCCC(CCCC)COC(=O)CCCCCCCCC(CCCCCCCCC(=O)OCC(CCCC)CCCCCC)N(CCCn1ccnc1)CC(CC)CCCC] |

TABLE 10a-continued
| Ionized lipid number | Structure |
|---|---|
| 16 | 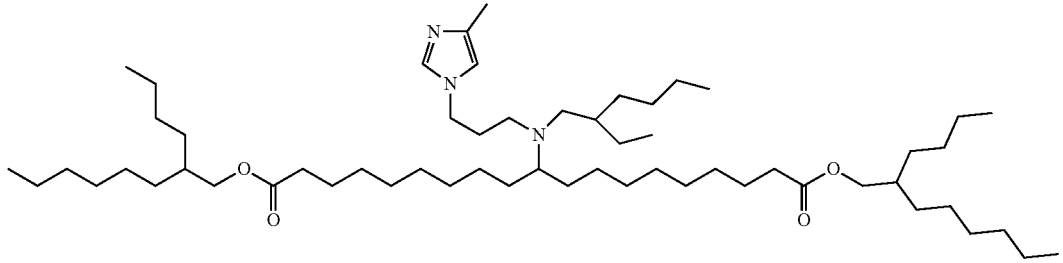 [SMILES: CCCCCCC(CCCC)COC(=O)CCCCCCCCC(CCCCCCCCC(=O)OCC(CCCC)CCCCCC)N(CCCn1cnc(C)c1)CC(CC)CCCC] |
| 17 | 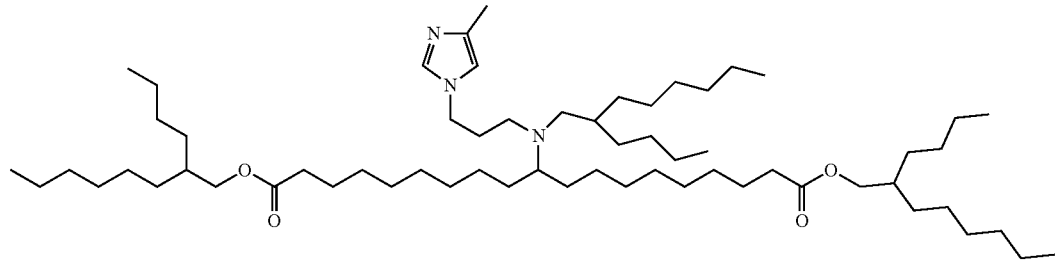 [SMILES: CCCCCCC(CCCC)COC(=O)CCCCCCCCC(CCCCCCCCC(=O)OCC(CCCC)CCCCCC)N(CCCn1cnc(C)c1)CC(CCCC)CCCCCC] |
| 18 | 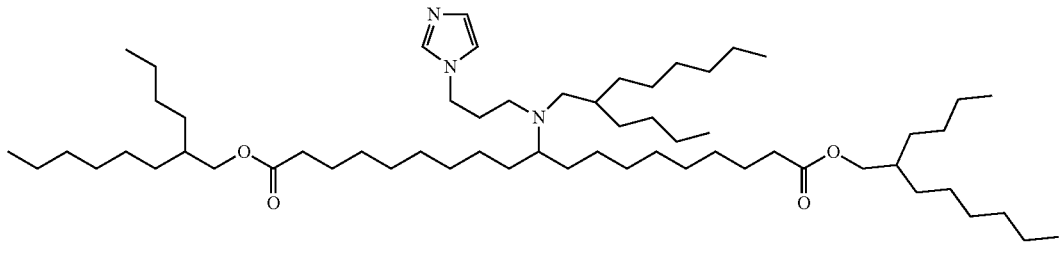 [SMILES: CCCCCCC(CCCC)COC(=O)CCCCCCCCC(CCCCCCCCC(=O)OCC(CCCC)CCCCCC)N(CCCn1ccnc1)CC(CCCC)CCCCCC] |
| 19 | 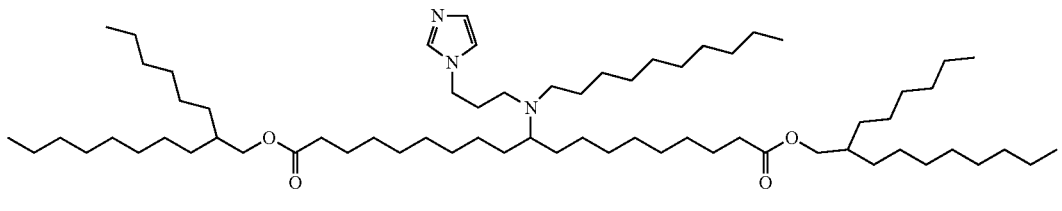 [SMILES: CCCCCCCCCCN(CCCn1ccnc1)C(CCCCCCCCC(=O)OCC(CCCCCC)CCCCCCCC)CCCCCCCCC(=O)OCC(CCCCCC)CCCCCCCC] |
| 20 | 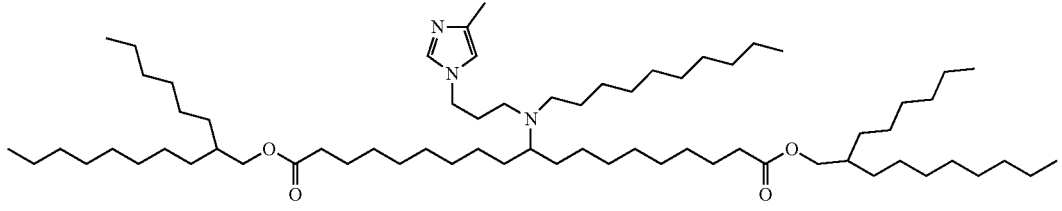 [SMILES: CCCCCCCCCCN(CCCn1cnc(C)c1)C(CCCCCCCCC(=O)OCC(CCCCCC)CCCCCCCC)CCCCCCCCC(=O)OCC(CCCCCC)CCCCCCCC] |
| 21 | 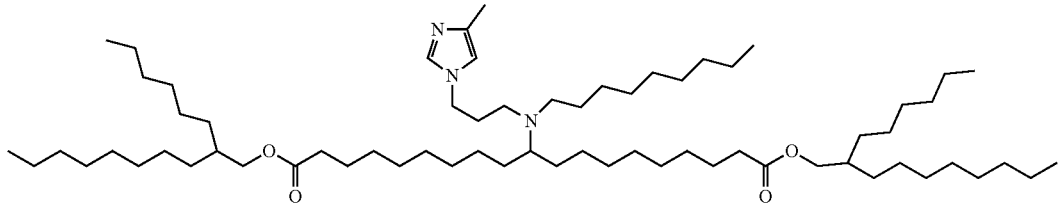 [SMILES: CCCCCCCCCN(CCCn1cnc(C)c1)C(CCCCCCCCC(=O)OCC(CCCCCC)CCCCCCCC)CCCCCCCCC(=O)OCC(CCCCCC)CCCCCCCC] |

TABLE 10a-continued
| Ionized lipid number | Structure |
|---|---|
| 22 | 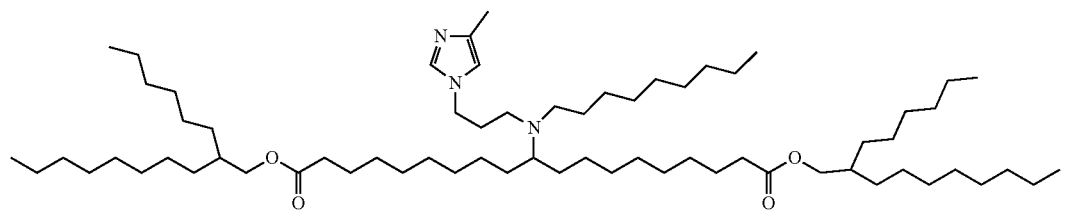 [SMILES: CCCCCCCCCN(CCCn1cnc(C)c1)C(CCCCCCCCC(=O)OCC(CCCCCC)CCCCCCCC)CCCCCCCCC(=O)OCC(CCCCCC)CCCCCCCC] |
| 23 | 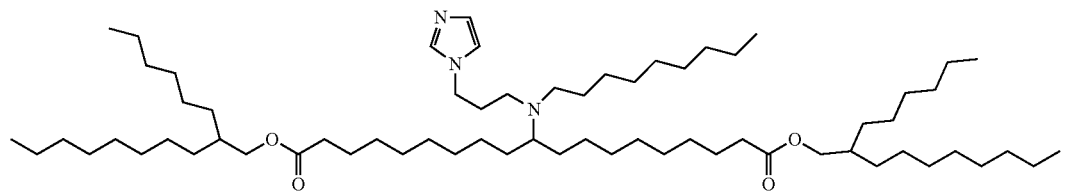 [SMILES: CCCCCCCCCN(CCCn1ccnc1)C(CCCCCCCCC(=O)OCC(CCCCCC)CCCCCCCC)CCCCCCCCC(=O)OCC(CCCCCC)CCCCCCCC] |
| 24 | 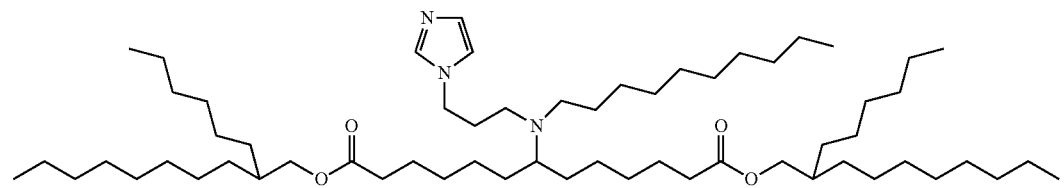 [SMILES: CCCCCCCCCCN(CCCn1ccnc1)C(CCCCCC(=O)OCC(CCCCCC)CCCCCCCC)CCCCCC(=O)OCC(CCCCCC)CCCCCCCC] |
| 25 | 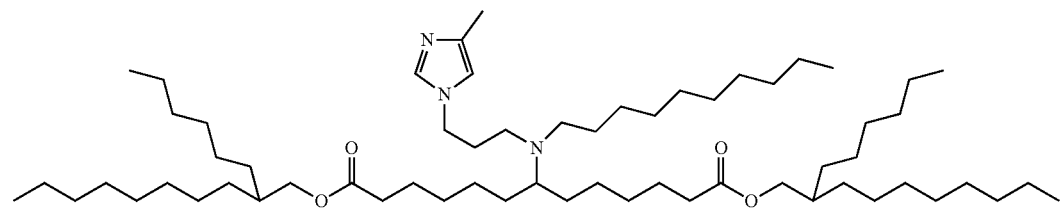 [SMILES: CCCCCCCCCCN(CCCn1cnc(C)c1)C(CCCCCC(=O)OCC(CCCCCC)CCCCCCCC)CCCCCC(=O)OCC(CCCCCC)CCCCCCCC] |
| 26 | 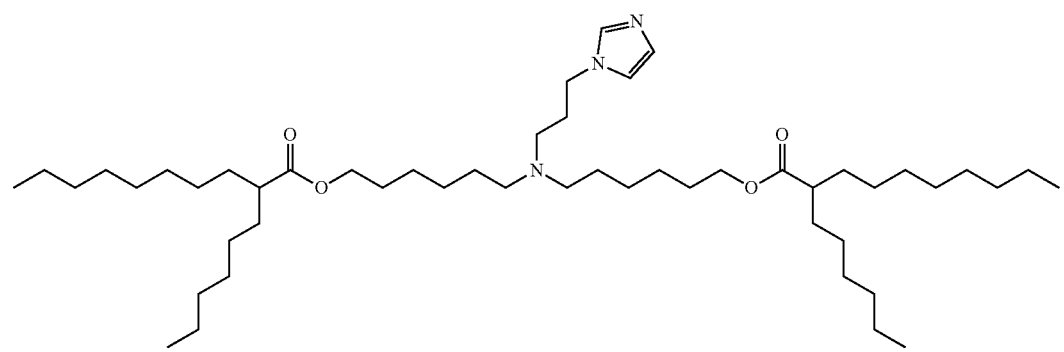 [SMILES: CCCCCCCCC(CCCCCC)C(=O)OCCCCCCN(CCCCCCOC(=O)C(CCCCCC)CCCCCCCC)CCCn1ccnc1] |
| 27 | 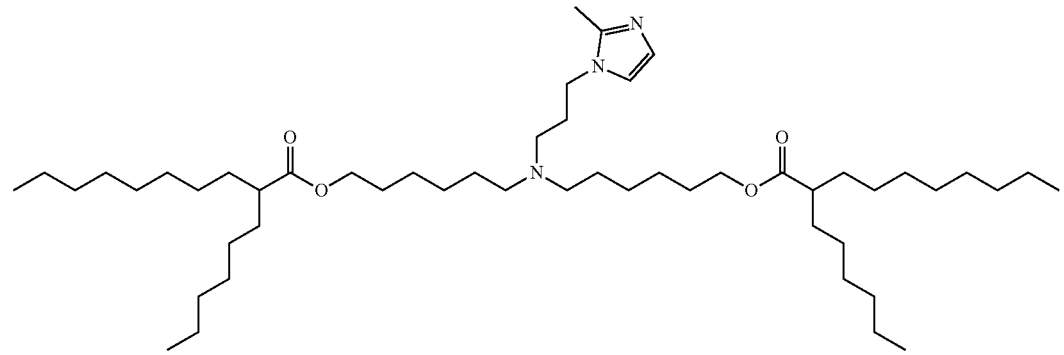 [SMILES: CCCCCCCCC(CCCCCC)C(=O)OCCCCCCN(CCCCCCOC(=O)C(CCCCCC)CCCCCCCC)CCCn1ccnc1C] |

TABLE 10a-continued
| Ionized lipid number | Structure |
|---|---|
| 28 | 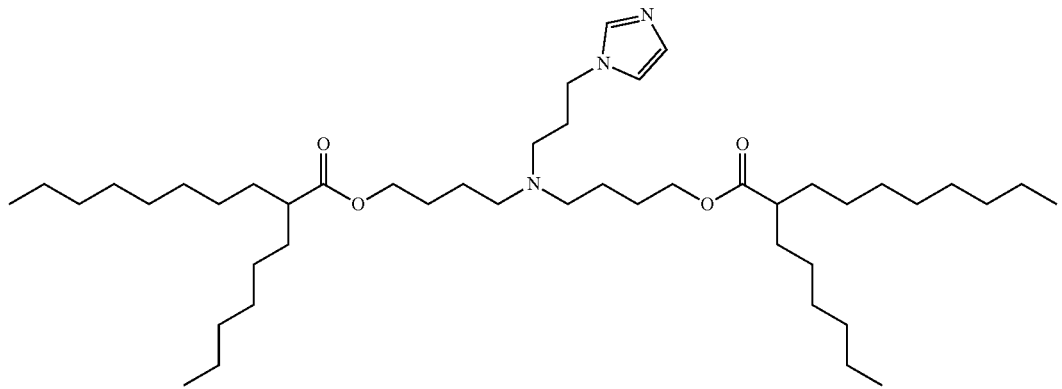 [SMILES: CCCCCCCCC(CCCCCC)C(=O)OCCCCN(CCCCOC(=O)C(CCCCCC)CCCCCCCC)CCCn1ccnc1] |
| 29 | 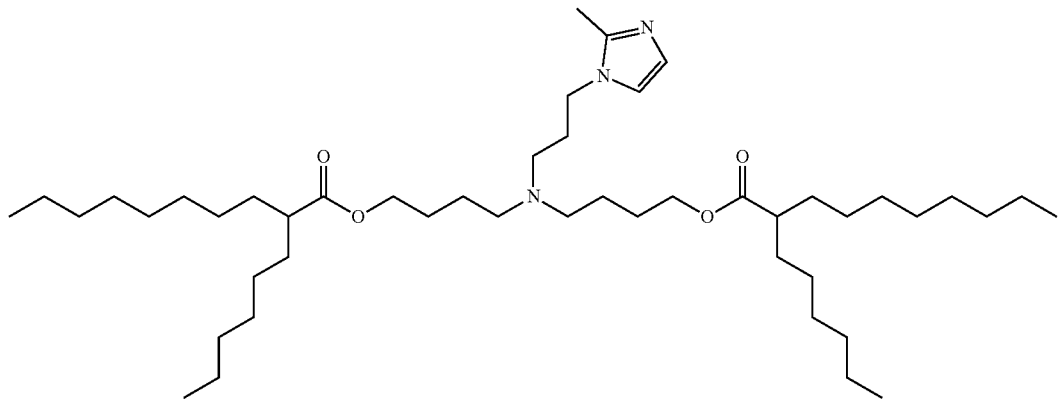 [SMILES: CCCCCCCCC(CCCCCC)C(=O)OCCCCN(CCCCOC(=O)C(CCCCCC)CCCCCCCC)CCCn1ccnc1C] |
| 30 | 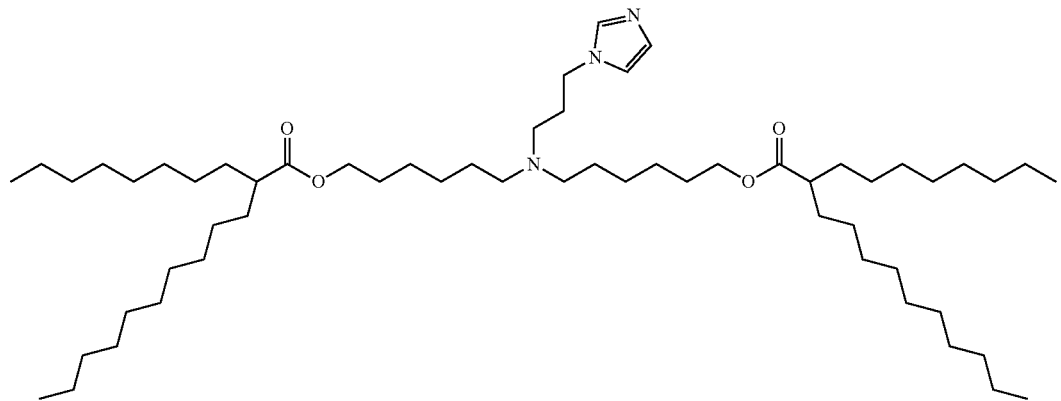 [SMILES: CCCCCCCCCCC(CCCCCCCC)C(=O)OCCCCCCN(CCCCCCOC(=O)C(CCCCCCCC)CCCCCCCCCC)CCCn1ccnc1] |

TABLE 10a-continued
| Ionized lipid number | Structure |
|---|---|
| 31 | 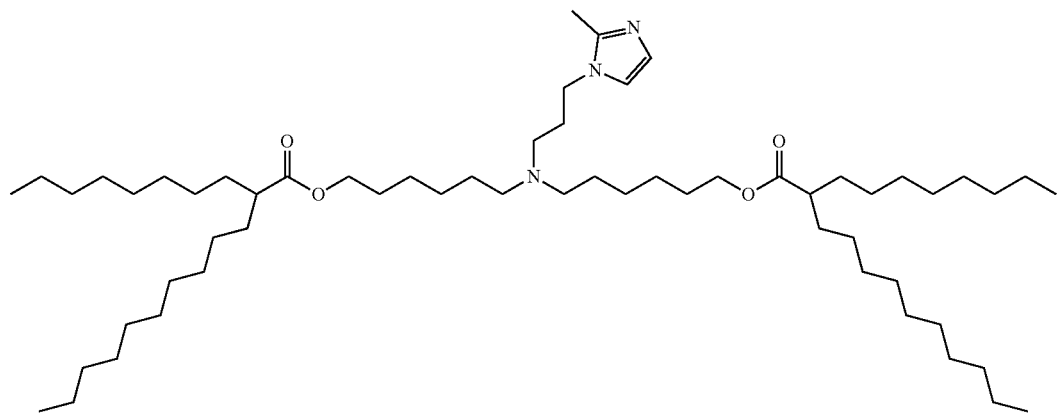 [SMILES: CCCCCCCCCCC(CCCCCCCC)C(=O)OCCCCCCN(CCCCCCOC(=O)C(CCCCCCCC)CCCCCCCCCC)CCCn1ccnc1C] |
| 32 | 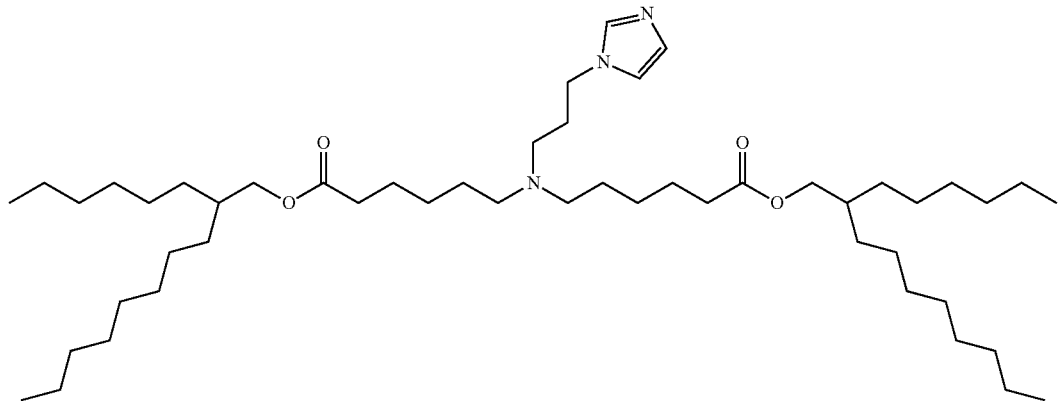 [SMILES: CCCCCCCCC(CCCCCC)COC(=O)CCCCCN(CCCCCC(=O)OCC(CCCCCC)CCCCCCCC)CCCn1ccnc1] |
| 33 | 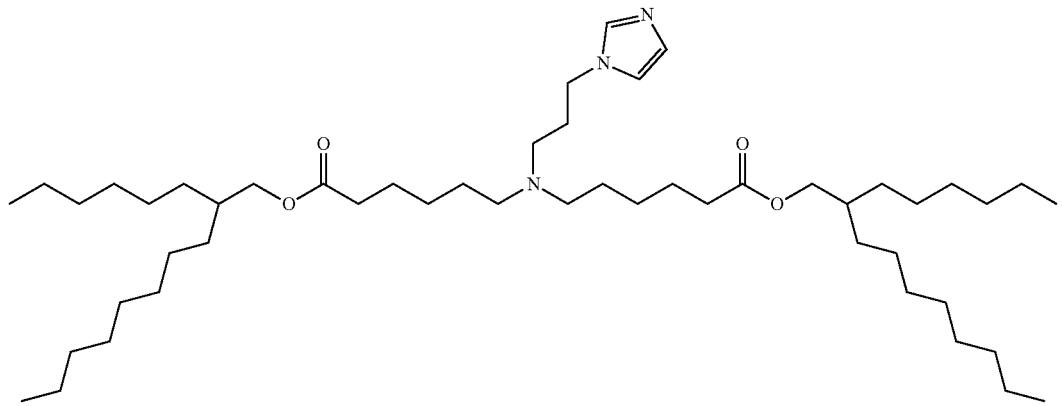 [SMILES: CCCCCCCCC(CCCCCC)COC(=O)CCCCCN(CCCCCC(=O)OCC(CCCCCC)CCCCCCCC)CCCn1ccnc1] |

TABLE 10a-continued
| Ionized lipid number | Structure |
|---|---|
| 34 | 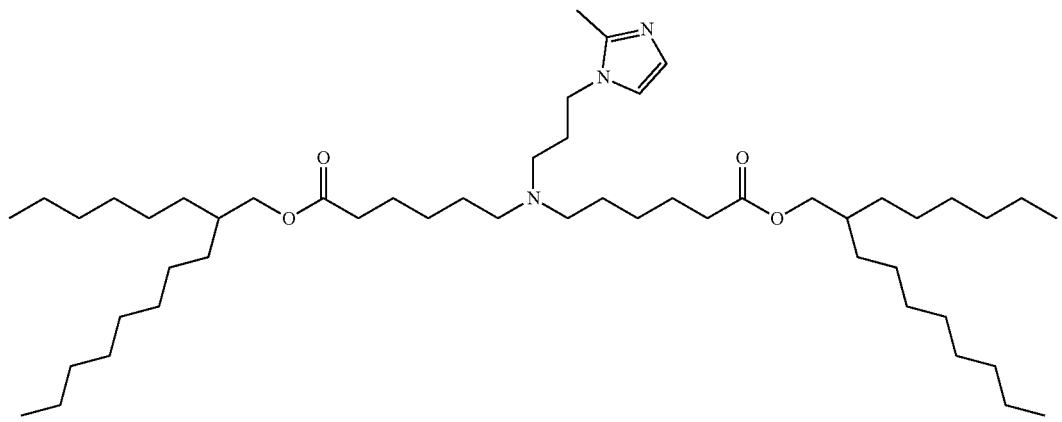 [SMILES: CCCCCCCCC(CCCCCC)COC(=O)CCCCCN(CCCCCC(=O)OCC(CCCCCC)CCCCCCCC)CCCn1ccnc1C] |
| 35 | 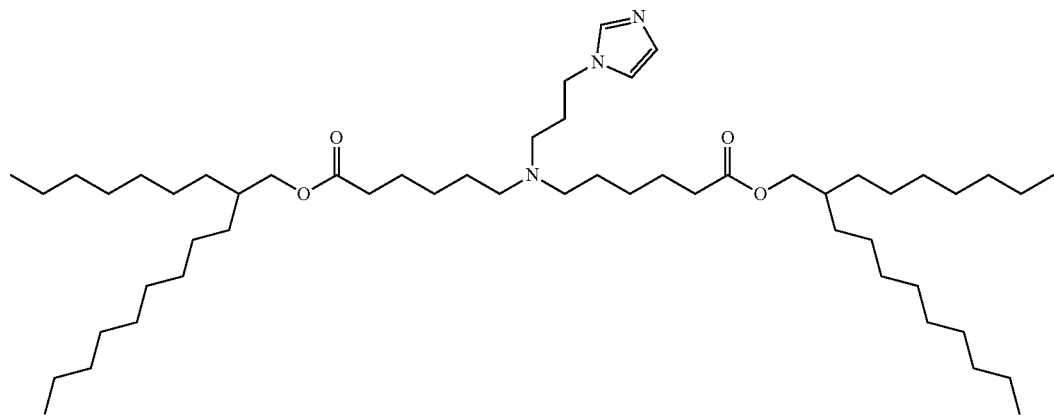 [SMILES: CCCCCCCCCC(CCCCCCC)COC(=O)CCCCCN(CCCCCC(=O)OCC(CCCCCCC)CCCCCCCCC)CCCn1ccnc1] |
| 36 | 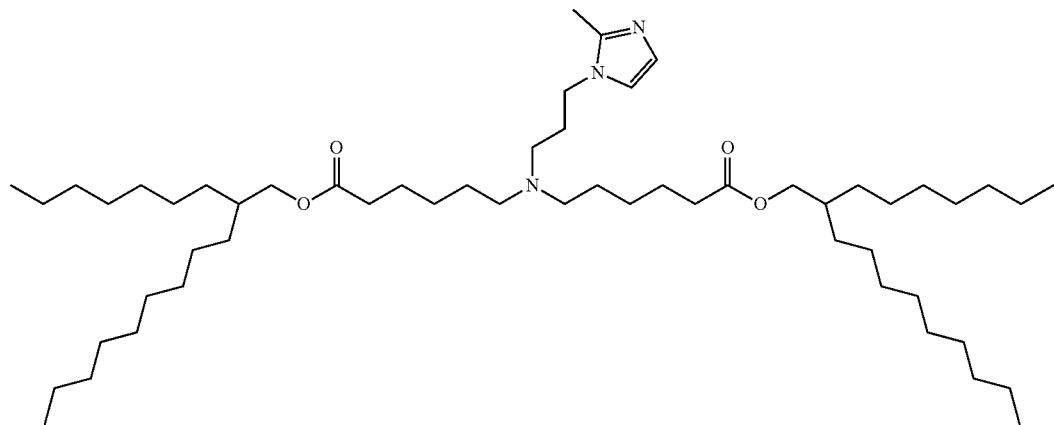 [SMILES: CCCCCCCCCC(CCCCCCC)COC(=O)CCCCCN(CCCCCC(=O)OCC(CCCCCCC)CCCCCCCCC)CCCn1ccnc1C] |

TABLE 10a-continued
| Ionized lipid number | Structure |
|---|---|
| 37 | 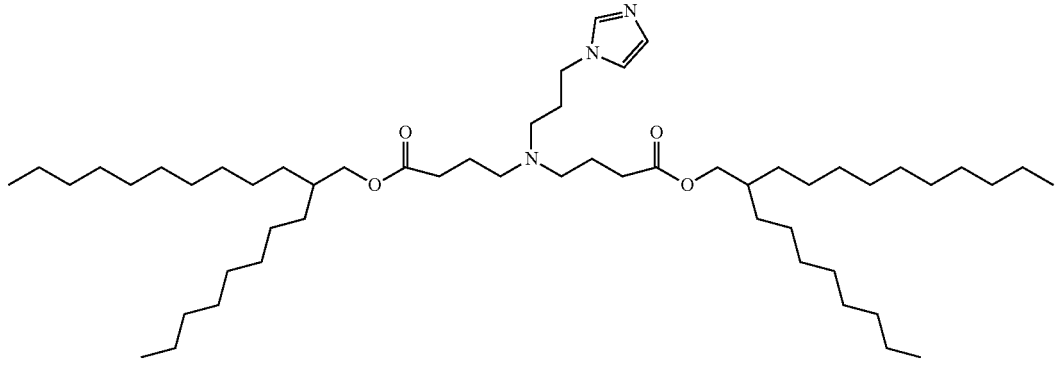 [SMILES: CCCCCCCCCCC(CCCCCCCC)COC(=O)CCCN(CCCC(=O)OCC(CCCCCCCC)CCCCCCCCCC)CCCn1ccnc1] |
| 38 | 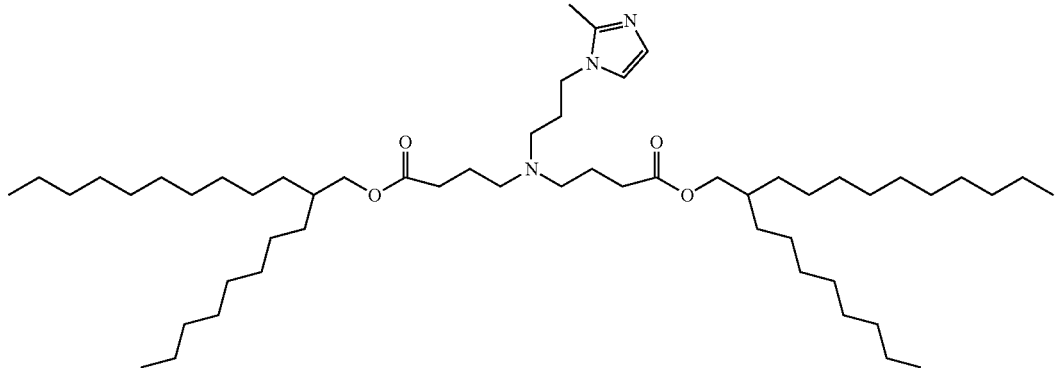 [SMILES: CCCCCCCCCCC(CCCCCCCC)COC(=O)CCCN(CCCC(=O)OCC(CCCCCCCC)CCCCCCCCCC)CCCn1ccnc1C] |
| 39 | 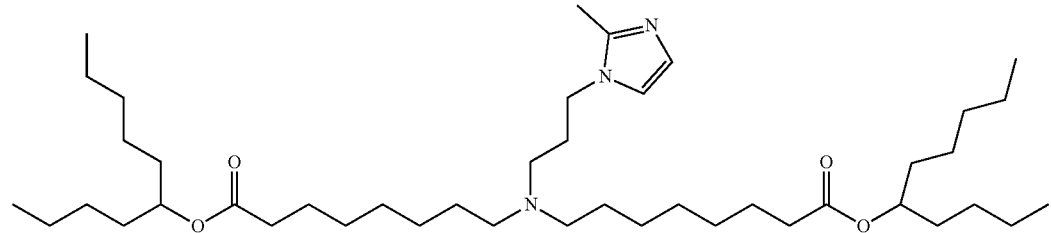 [SMILES: CCCCCC(CCCC)OC(=O)CCCCCCCN(CCCCCCCC(=O)OC(CCCC)CCCCC)CCCn1ccnc1C] |
| 40 | 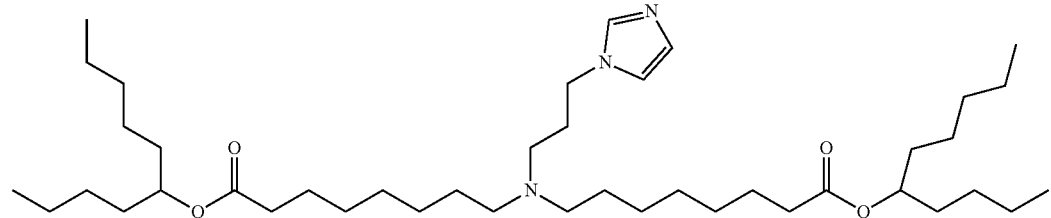 [SMILES: CCCCCC(CCCC)OC(=O)CCCCCCCN(CCCCCCCC(=O)OC(CCCC)CCCCC)CCCn1ccnc1] |

TABLE 10a-continued
| Ionized lipid number | Structure |
|---|---|
| 41 | 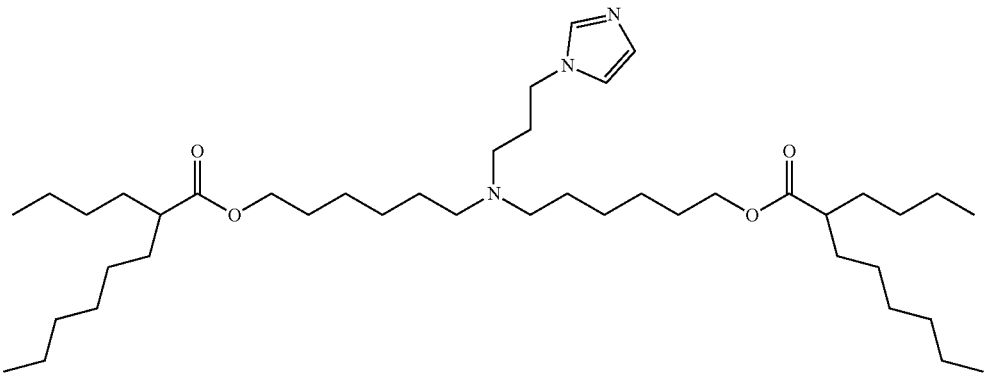 [SMILES: CCCCCCC(CCCC)C(=O)OCCCCCCN(CCCCCCOC(=O)C(CCCC)CCCCCC)CCCn1ccnc1] |
| 42 | 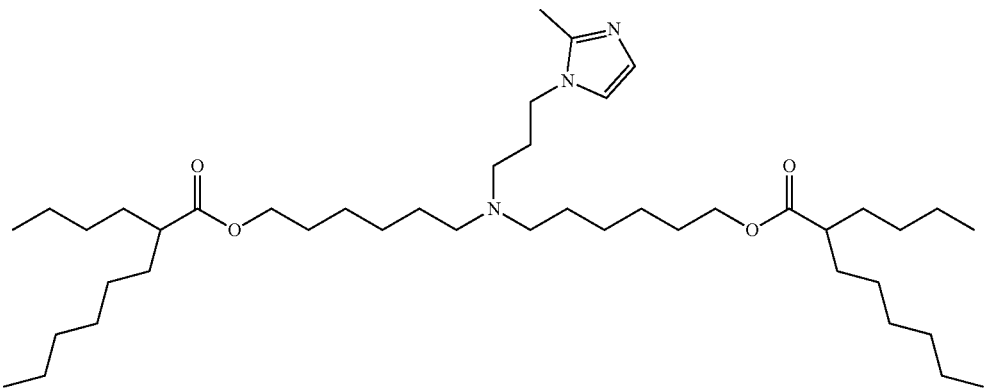 [SMILES: CCCCCCC(CCCC)C(=O)OCCCCCCN(CCCCCCOC(=O)C(CCCC)CCCCCC)CCCn1ccnc1C] |
| 43 | 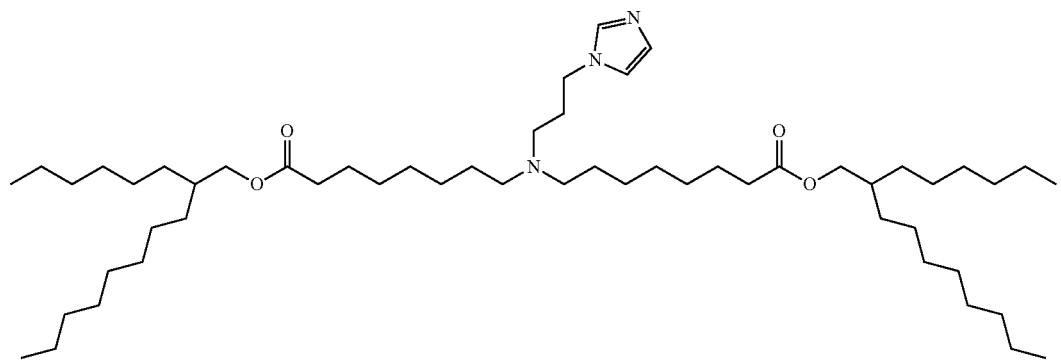 [SMILES: CCCCCCCCC(CCCCCC)COC(=O)CCCCCCCN(CCCCCCCC(=O)OCC(CCCCCC)CCCCCCCC)CCCn1ccnc1] |
| 44 | 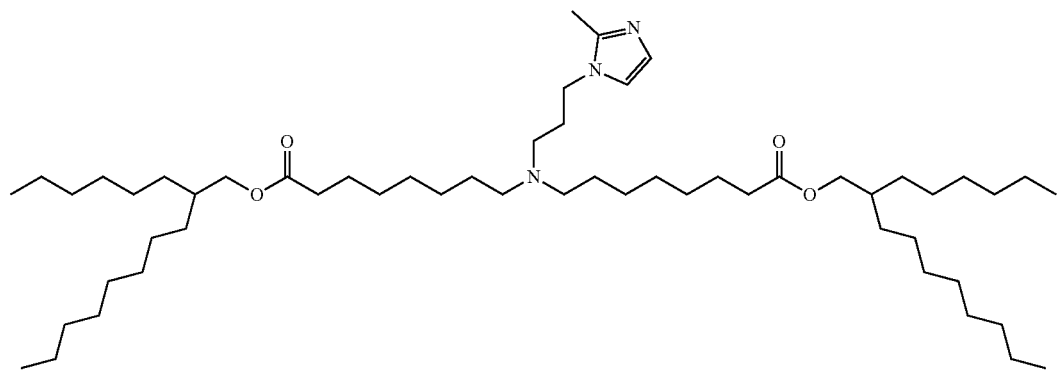 [SMILES: CCCCCCCCC(CCCCCC)COC(=O)CCCCCCCN(CCCCCCCC(=O)OCC(CCCCCC)CCCCCCCC)CCCn1ccnc1C] |

TABLE 10a-continued
| Ionized lipid number | Structure |
|---|---|
| 45 | 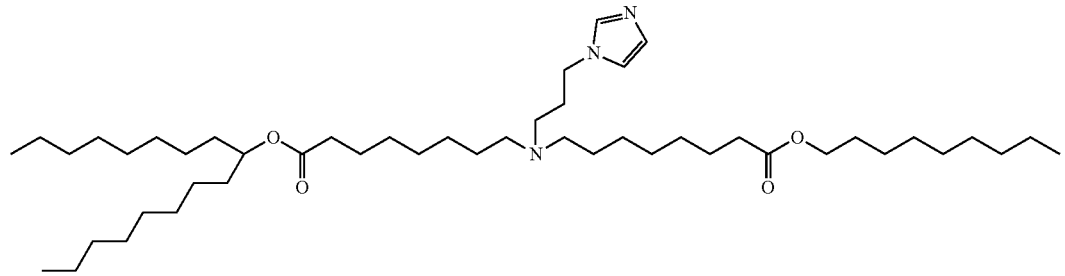 [SMILES: CCCCCCCCCOC(=O)CCCCCCCN(CCCCCCCC(=O)OC(CCCCCCCC)CCCCCCCC)CCCn1ccnc1] |
| 46 | 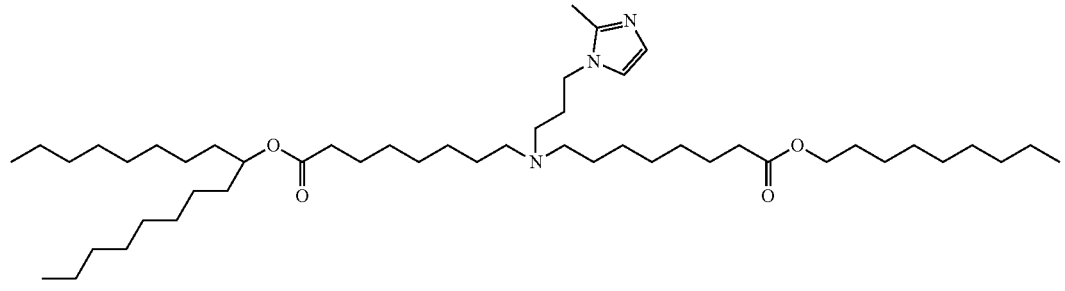 [SMILES: CCCCCCCCCOC(=O)CCCCCCCN(CCCCCCCC(=O)OC(CCCCCCCC)CCCCCCCC)CCCn1ccnc1C] |
| 47 | 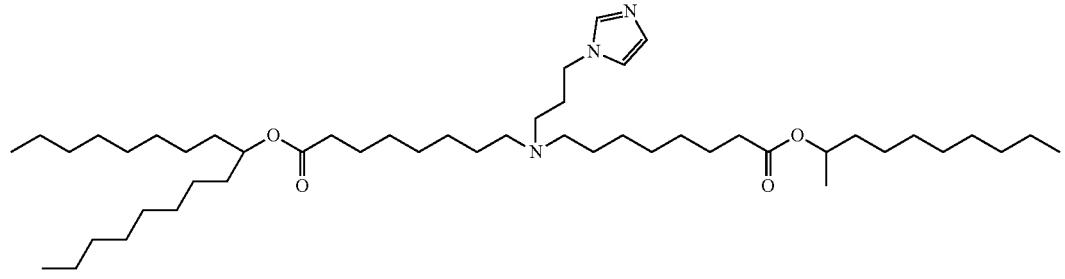 [SMILES: CCCCCCCCC(C)OC(=O)CCCCCCCN(CCCCCCCC(=O)OC(CCCCCCCC)CCCCCCCC)CCCn1ccnc1] |
| 48 | 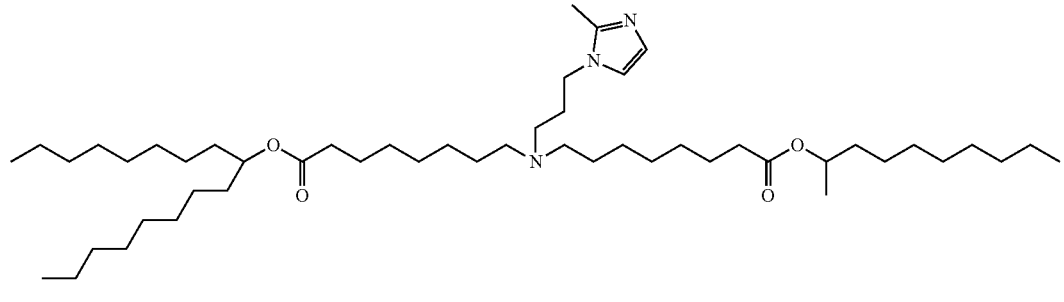 [SMILES: CCCCCCCCC(C)OC(=O)CCCCCCCN(CCCCCCCC(=O)OC(CCCCCCCC)CCCCCCCC)CCCn1ccnc1C] |
| 49 | 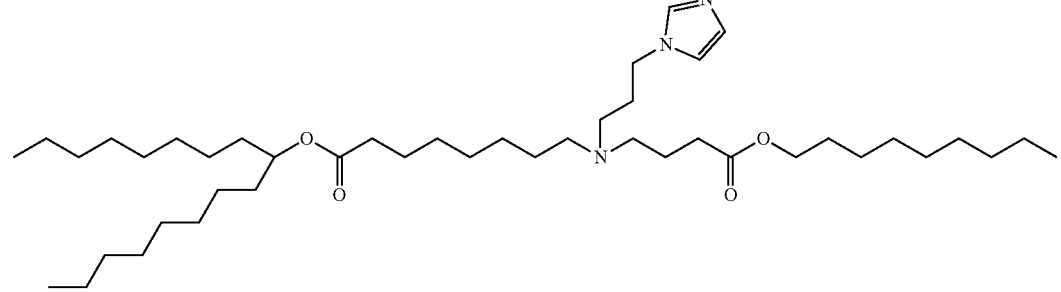 |

TABLE 10a-continued
| Ionized lipid number | Structure |
|---|---|
| 50 | 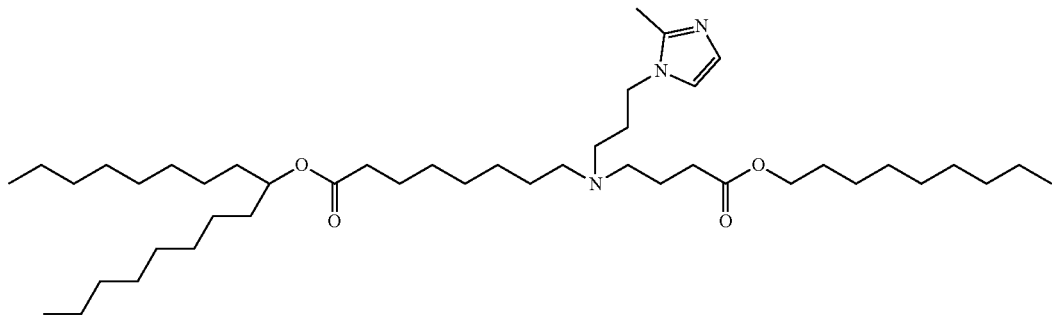 [SMILES: CCCCCCCCCOC(=O)CCCN(CCCCCCCC(=O)OC(CCCCCCCC)CCCCCCCC)CCCn1ccnc1C] |
| 51 | 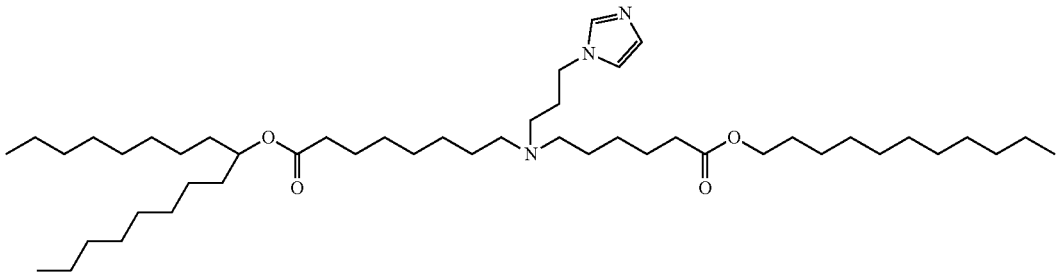 [SMILES: CCCCCCCCCCCOC(=O)CCCCCN(CCCCCCCC(=O)OC(CCCCCCCC)CCCCCCCC)CCCn1ccnc1] |
| 52 | 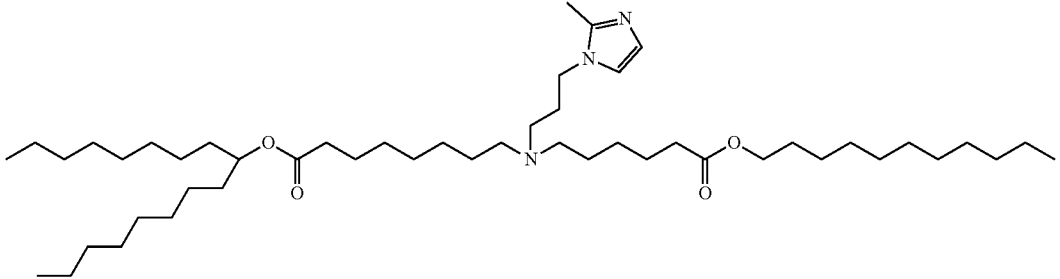 [SMILES: CCCCCCCCCCCOC(=O)CCCCCN(CCCCCCCC(=O)OC(CCCCCCCC)CCCCCCCC)CCCn1ccnc1C] |
| 53 | 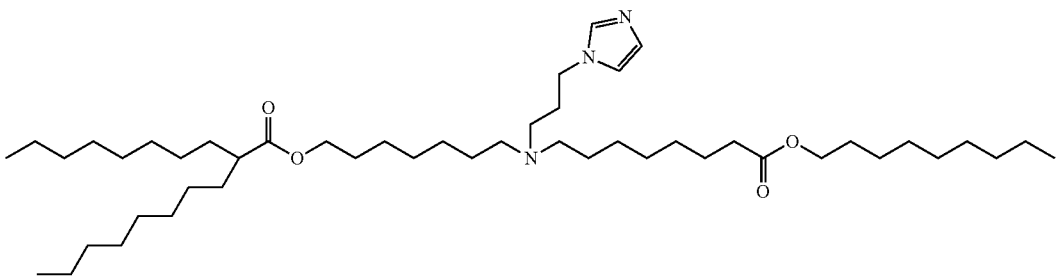 [SMILES: CCCCCCCCCOC(=O)CCCCCCCN(CCCCCCCOC(=O)C(CCCCCCCC)CCCCCCCC)CCCn1ccnc1] |
| 54 | 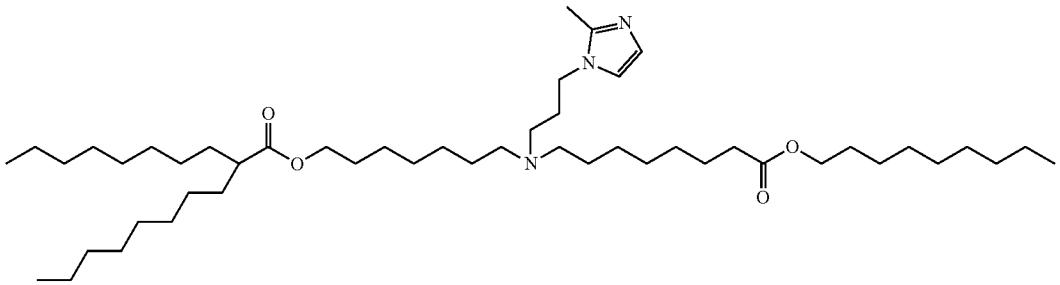 [SMILES: CCCCCCCCCOC(=O)CCCCCCCN(CCCCCCCOC(=O)C(CCCCCCCC)CCCCCCCC)CCCn1ccnc1C] |

TABLE 10a-continued
| Ionized lipid number | Structure |
|---|---|
| 55 | 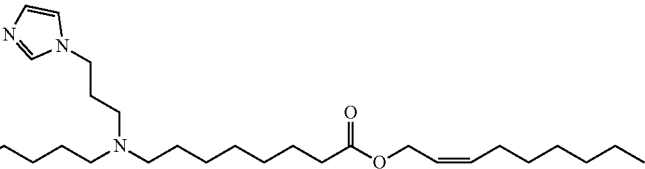 |
| 56 | 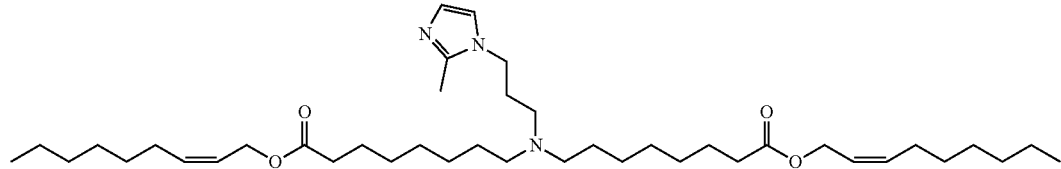 [SMILES: CCCCCC/C=C\COC(=O)CCCCCCCN(CCCCCCCC(=O)OC/C=C\CCCCCC)CCCn1ccnc1C] |
| 57 | 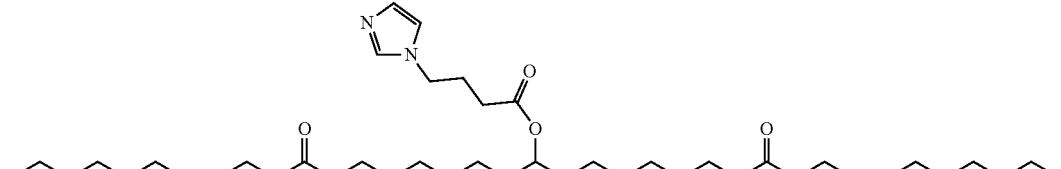 |
| 58 | 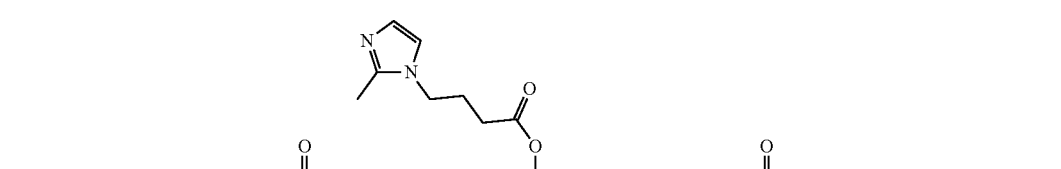 |
| 59 | 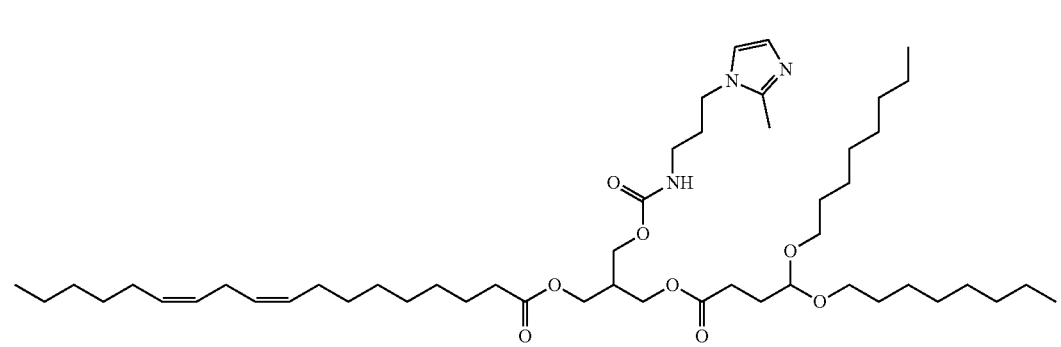 [SMILES: CCCCC/C=C\C/C=C\CCCCCCCC(=O)OCC(COC(=O)CCC(OCCCCCCCC)OCCCCCCCC)COC(=O)NCCCn1ccnc1C] |
| 60 | 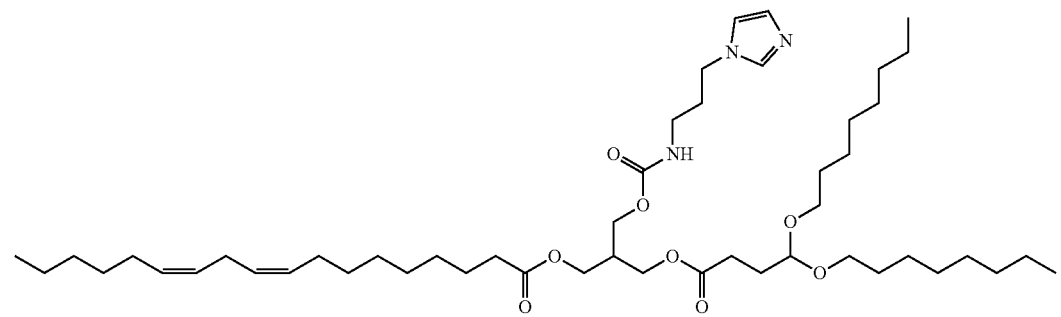 [SMILES: CCCCC/C=C\C/C=C\CCCCCCCC(=O)OCC(COC(=O)CCC(OCCCCCCCC)OCCCCCCCC)COC(=O)NCCCn1ccnc1] |

TABLE 10a-continued
| Ionized lipid number | Structure |
|---|---|
| 61 | 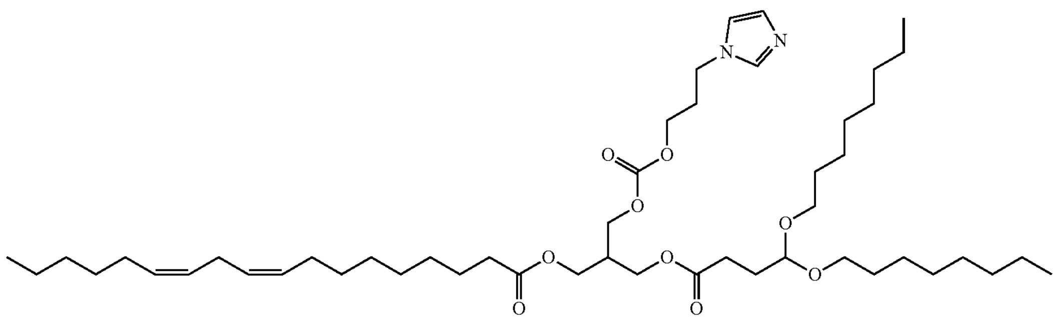 [SMILES: CCCCC/C=C\C/C=C\CCCCCCCC(=O)OCC(COC(=O)CCC(OCCCCCCCC)OCCCCCCCC)COC(=O)OCCCn1ccnc1] |
| 62 | 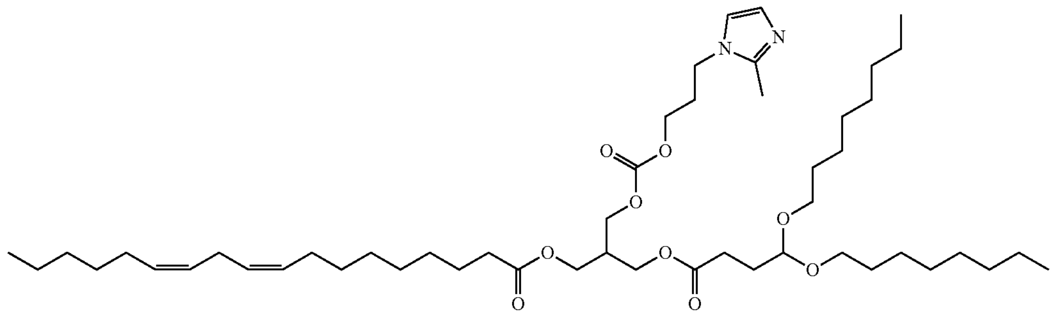 [SMILES: CCCCC/C=C\C/C=C\CCCCCCCC(=O)OCC(COC(=O)CCC(OCCCCCCCC)OCCCCCCCC)COC(=O)OCCCn1ccnc1C] |
| 63 | 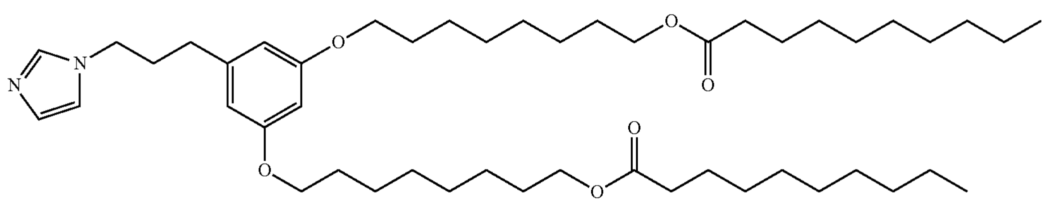 [SMILES: CCCCCCCCCC(=O)OCCCCCCCCOc1cc(CCCn2ccnc2)cc(OCCCCCCCCOC(=O)CCCCCCCCC)c1] |
| 64 | 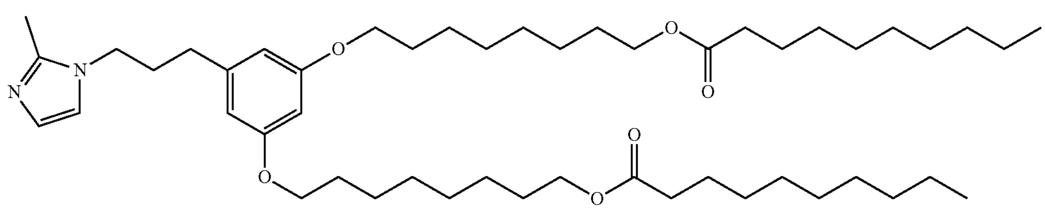 [SMILES: CCCCCCCCCC(=O)OCCCCCCCCOc1cc(CCCn2ccnc2C)cc(OCCCCCCCCOC(=O)CCCCCCCCC)c1] |
| 65 | 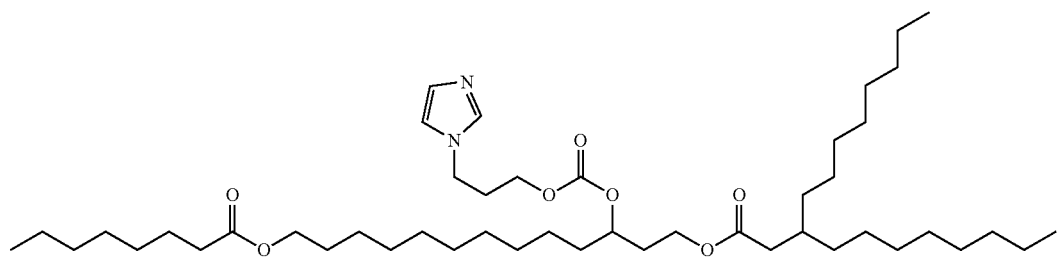 [SMILES: CCCCCCCCC(CCCCCCCC)CC(=O)OCCC(CCCCCCCCCCOC(=O)CCCCCCC)OC(=O)OCCCn1ccnc1] |

TABLE 10a-continued
| Ionized lipid number | Structure |
|---|---|
| 66 | 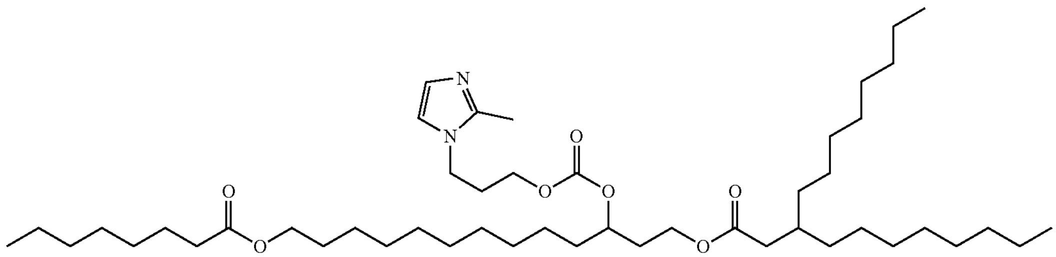 [SMILES: CCCCCCCCC(CCCCCCCC)CC(=O)OCCC(CCCCCCCCCCOC(=O)CCCCCCC)OC(=O)OCCCn1ccnc1C] |
| 67 | 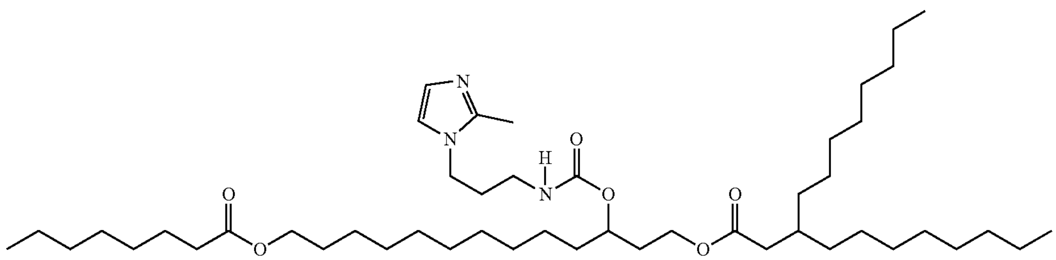 [SMILES: CCCCCCCCC(CCCCCCCC)CC(=O)OCCC(CCCCCCCCCCOC(=O)CCCCCCC)OC(=O)NCCCn1ccnc1C] |
| 68 | 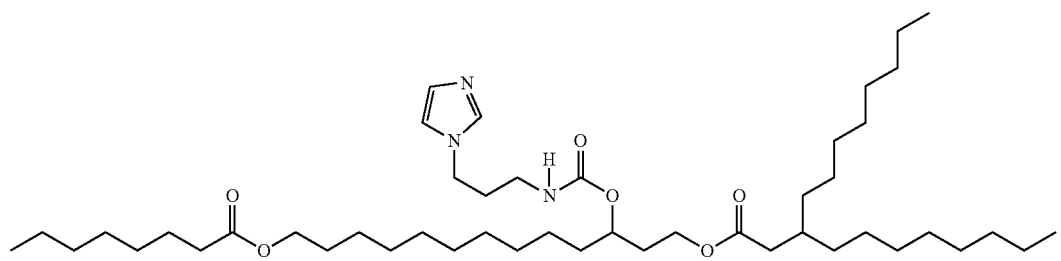 [SMILES: CCCCCCCCC(CCCCCCCC)CC(=O)OCCC(CCCCCCCCCCOC(=O)CCCCCCC)OC(=O)NCCCn1ccnc1] |
| 69 | 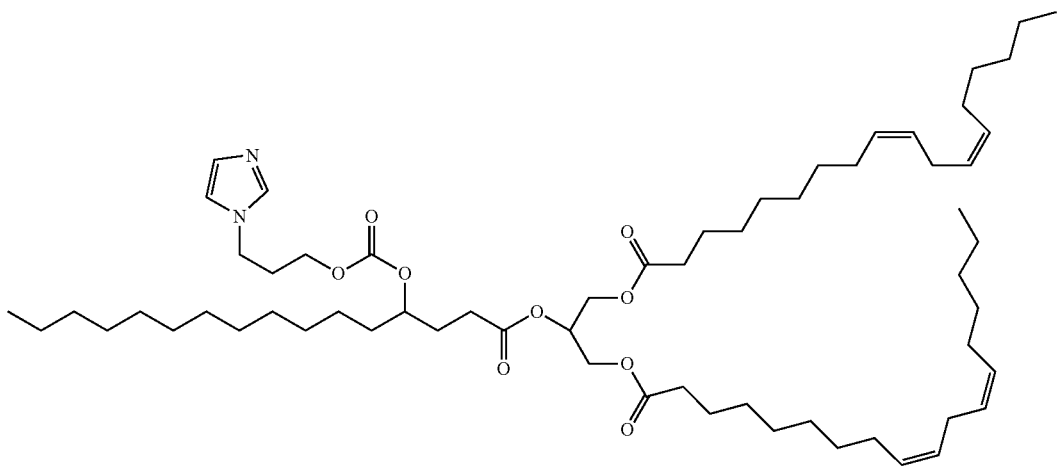 [SMILES: CCCCC/C=C\C/C=C\CCCCCCCC(=O)OCC(COC(=O)CCCCCCC/C=C\C/C=C\CCCCC)OC(=O)CCC(CCCCCCCCCCCC)OC(=O)OCCCn1ccnc1] |

TABLE 10a-continued

| Ionized lipid number | Structure |
|---|---|
| 70 | 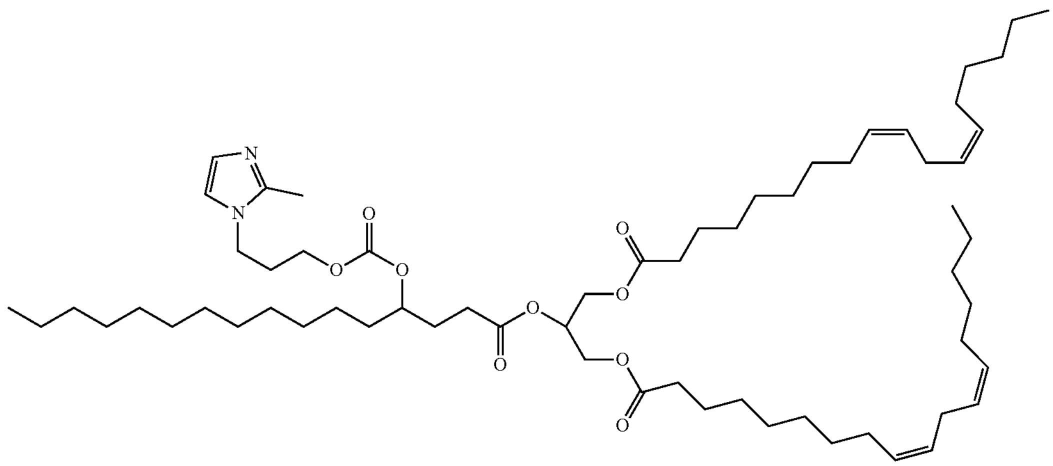 [SMILES: CCCCC/C=C\C/C=C\CCCCCCCC(=O)OCC(COC(=O)CCCCCCC/C=C\C/C=C\CCCCC)OC(=O)CCC(CCCCCCCCCCCC)OC(=O)OCCCn1ccnc1C] |
| 71 | 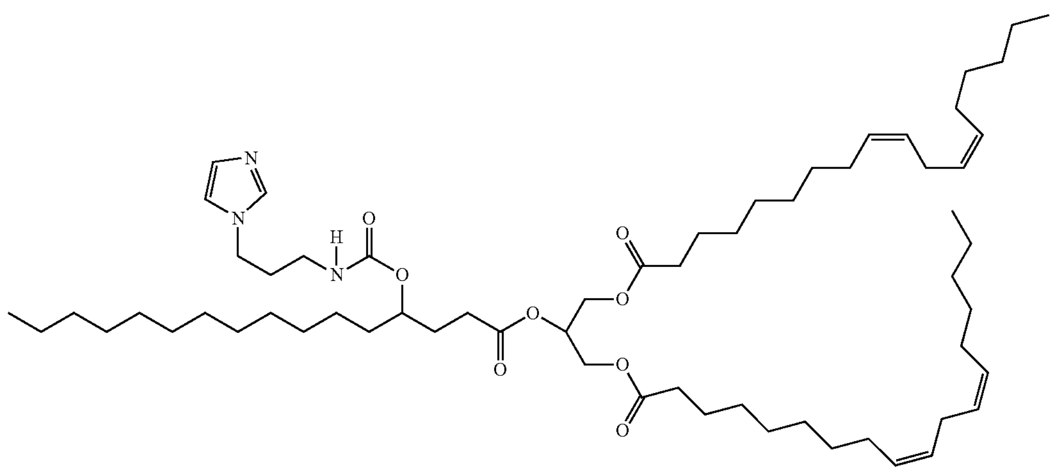 [SMILES: CCCCC/C=C\C/C=C\CCCCCCCC(=O)OCC(COC(=O)CCCCCCC/C=C\C/C=C\CCCCC)OC(=O)CCC(CCCCCCCCCCCC)OC(=O)NCCCn1ccnc1] |
| 72 | 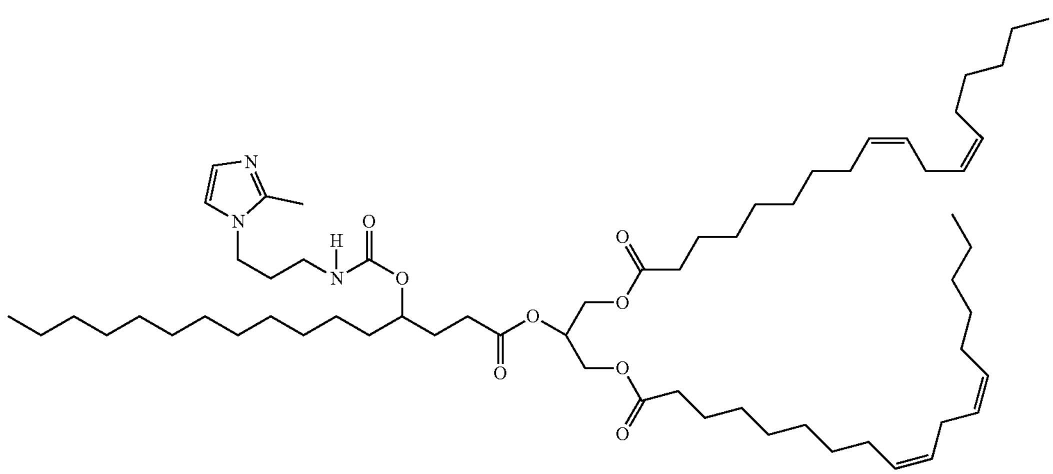 [SMILES: CCCCC/C=C\C/C=C\CCCCCCCC(=O)OCC(COC(=O)CCCCCCC/C=C\C/C=C\CCCCC)OC(=O)CCC(CCCCCCCCCCCC)OC(=O)NCCCn1ccnc1C] |

TABLE 10a-continued
| Ionized lipid number | Structure |
|---|---|
| 73 | 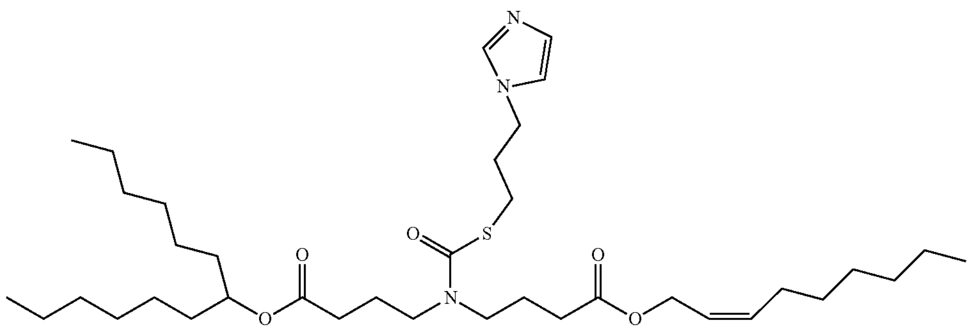 [SMILES: CCCCCC/C=C\COC(=O)CCCN(CCCC(=O)OC(CCCCCC)CCCCCC)C(=O)SCCCn1ccnc1] |
| 74 | 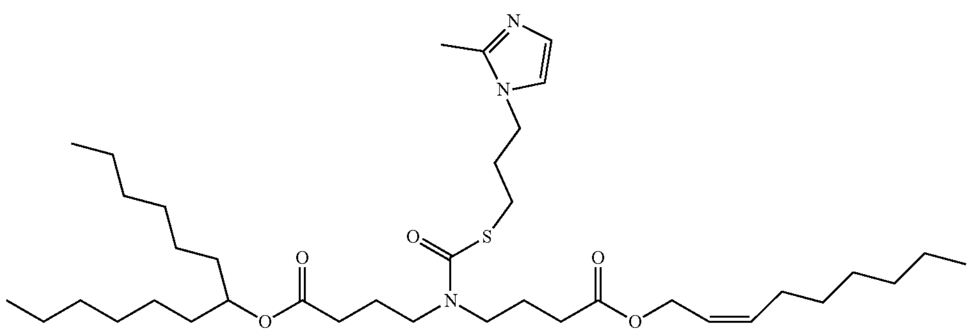 [SMILES: CCCCCC/C=C\COC(=O)CCCN(CCCC(=O)OC(CCCCCC)CCCCCC)C(=O)SCCCn1ccnc1C] |
| 75 | 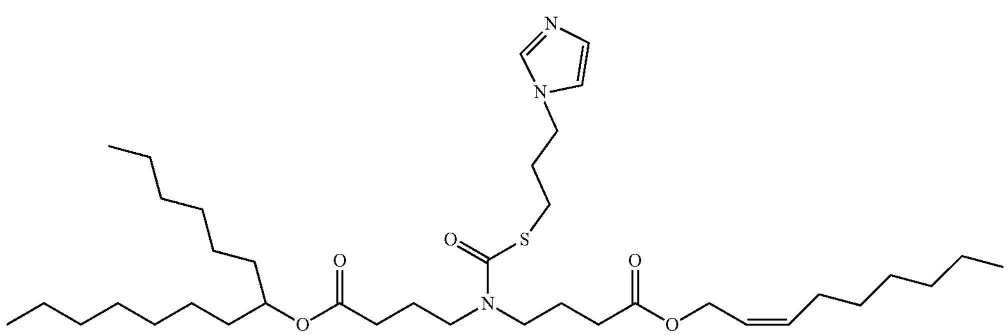 [SMILES: CCCCCC/C=C\COC(=O)CCCN(CCCC(=O)OC(CCCCCC)CCCCCCC)C(=O)SCCCn1ccnc1] |
| 76 | 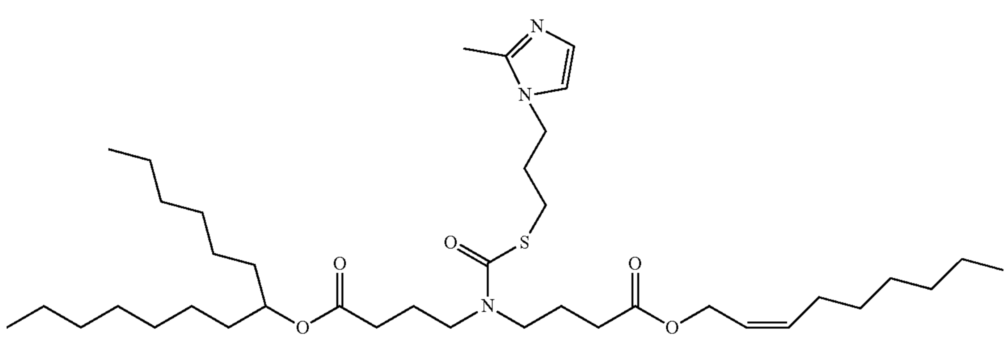 [SMILES: CCCCCC/C=C\COC(=O)CCCN(CCCC(=O)OC(CCCCCC)CCCCCCC)C(=O)SCCCn1ccnc1C] |

TABLE 10a-continued
| Ionized lipid number | Structure |
|---|---|
| 77 | 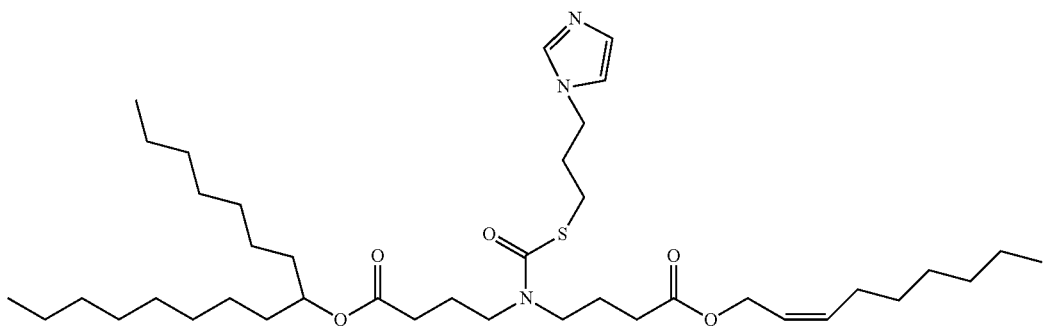 [SMILES: CCCCCC/C=C\COC(=O)CCCN(CCCC(=O)OC(CCCCCCC)CCCCCCCC)C(=O)SCCCn1ccnc1] |
| 78 | 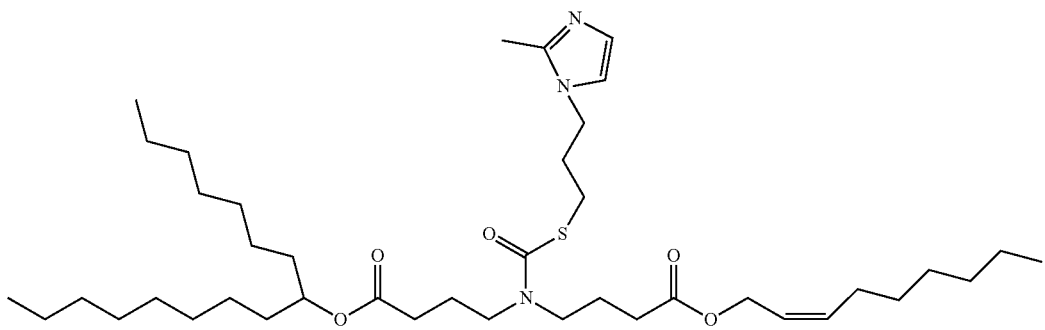 [SMILES: CCCCCC/C=C\COC(=O)CCCN(CCCC(=O)OC(CCCCCCC)CCCCCCCC)C(=O)SCCCn1ccnc1C] |
| 79 | 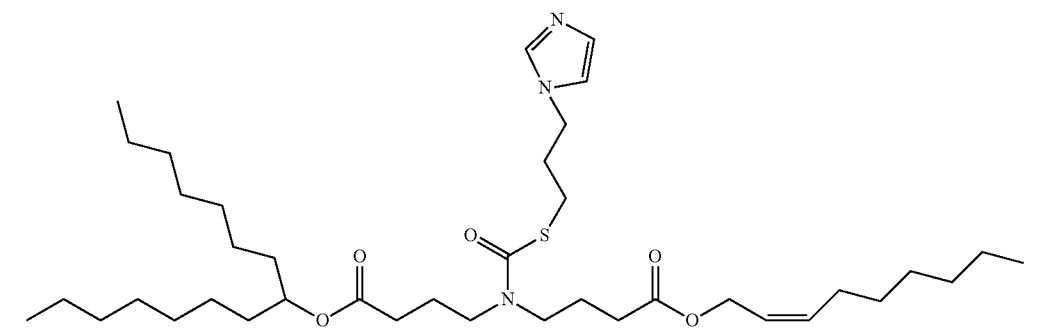 [SMILES: CCCCCC/C=C\COC(=O)CCCN(CCCC(=O)OC(CCCCCCC)CCCCCCC)C(=O)SCCCn1ccnc1] |
| 80 | 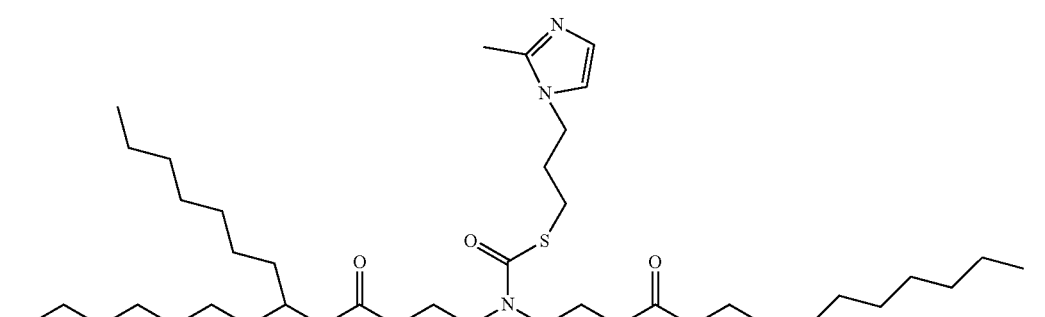 |

TABLE 10a-continued
| Ionized lipid number | Structure |
|---|---|
| 81 | 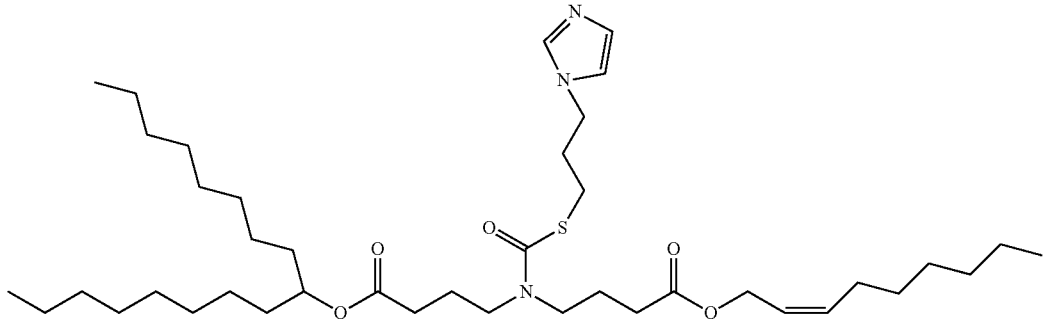 [SMILES: CCCCCC/C=C\COC(=O)CCCN(CCCC(=O)OC(CCCCCCCC)CCCCCCCC)C(=O)SCCCn1ccnc1] |
| 82 | 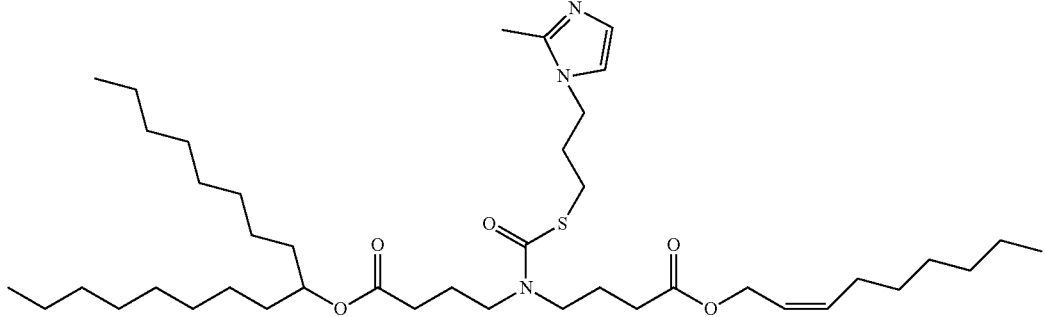 [SMILES: CCCCCC/C=C\COC(=O)CCCN(CCCC(=O)OC(CCCCCCCC)CCCCCCCC)C(=O)SCCCn1ccnc1C] |
| 83 | 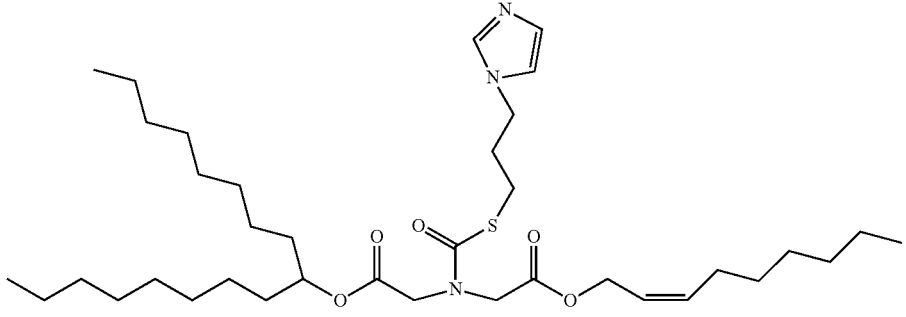 [SMILES: CCCCCC/C=C\COC(=O)CN(CC(=O)OC(CCCCCCCC)CCCCCCCC)C(=O)SCCCn1ccnc1] |
| 84 | 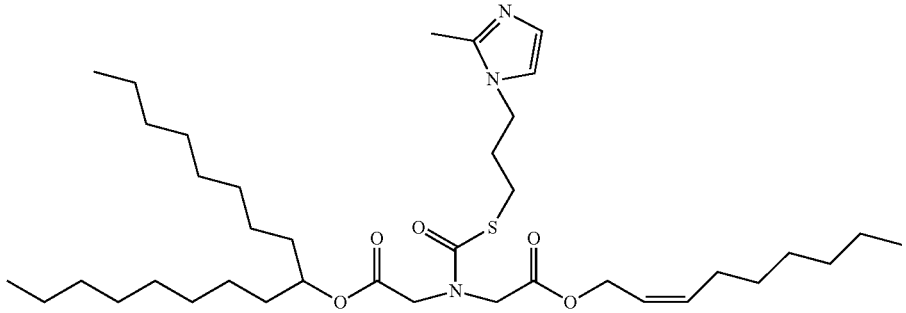 [SMILES: CCCCCC/C=C\COC(=O)CN(CC(=O)OC(CCCCCCCC)CCCCCCCC)C(=O)SCCCn1ccnc1C] |

TABLE 10a-continued
| Ionized lipid number | Structure |
|---|---|
| 85 | 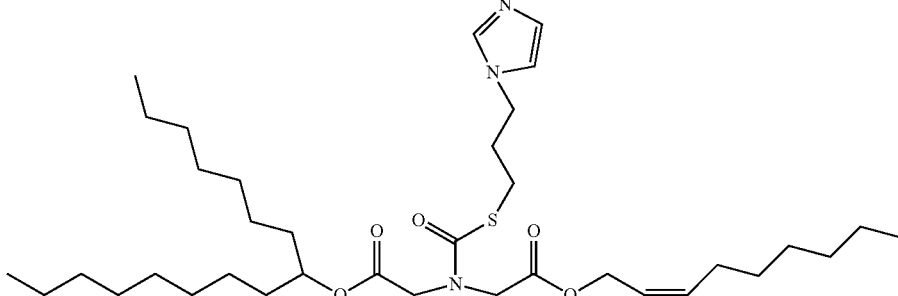 |
| 86 | 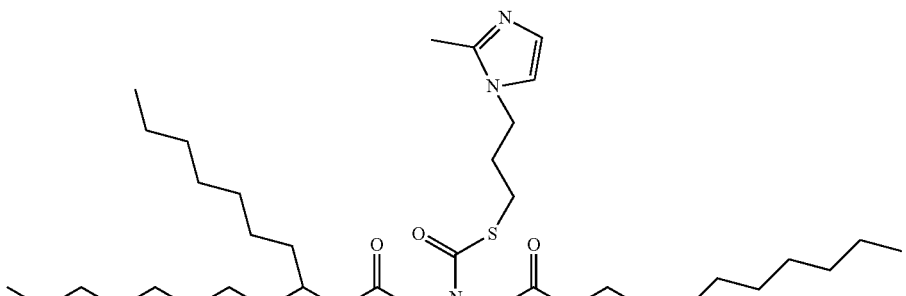 |
| 87 | 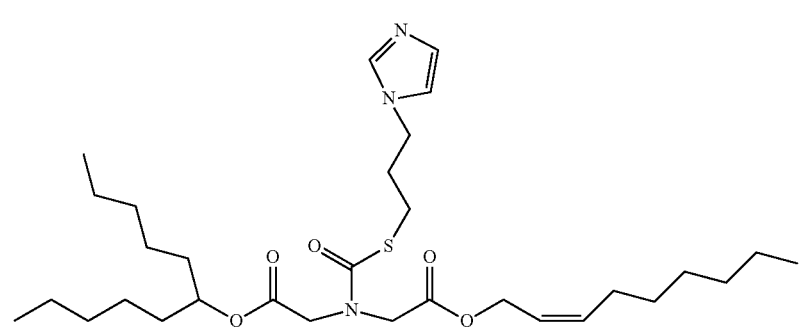 [SMILES: CCCCCC/C=C\COC(=O)CN(CC(=O)OC(CCCCC)CCCCC)C(=O)SCCCn1ccnc1] |
| 88 | 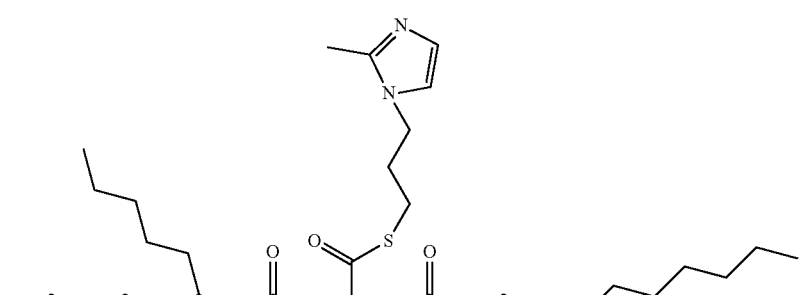 |

TABLE 10a-continued
| Ionized lipid number | Structure |
|---|---|
| 89 | 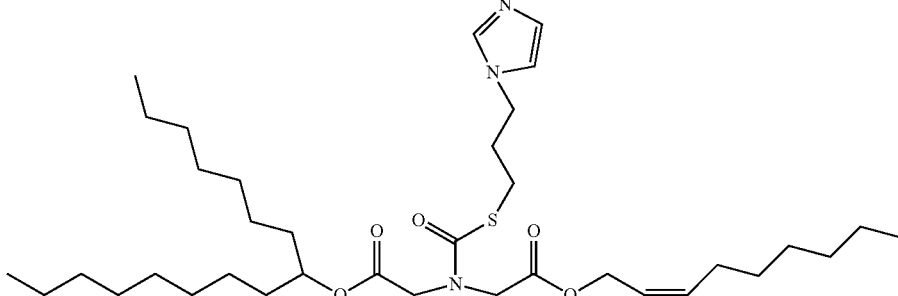 |
| 90 | 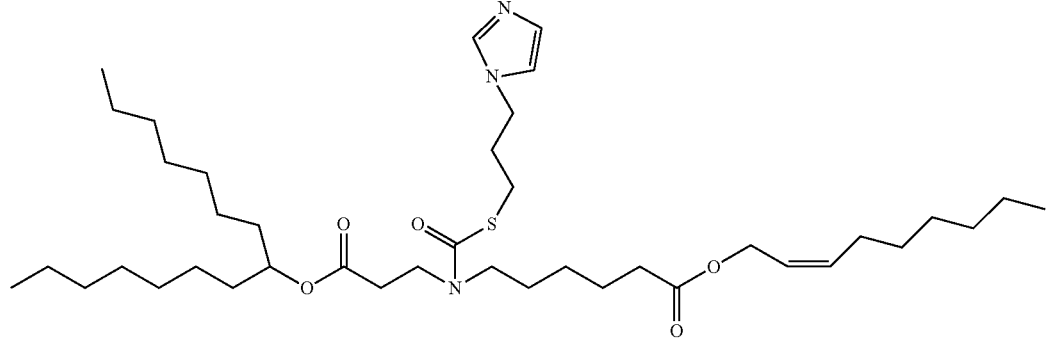 [SMILES: CCCCCC/C=C\COC(=O)CCCCCN(CCC(=O)OC(CCCCCCC)CCCCCCC)C(=O)SCCCn1ccnc1] |
| 91 | 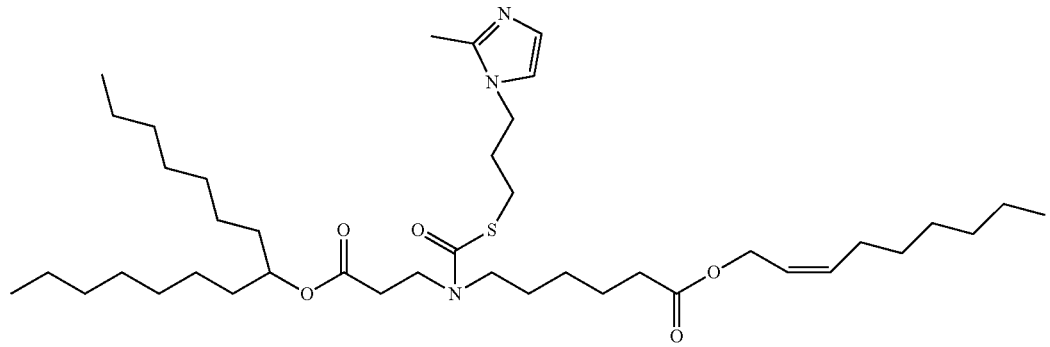 [SMILES: CCCCCC/C=C\COC(=O)CCCCCN(CCC(=O)OC(CCCCCCC)CCCCCCC)C(=O)SCCCn1ccnc1C] |
| 92 | 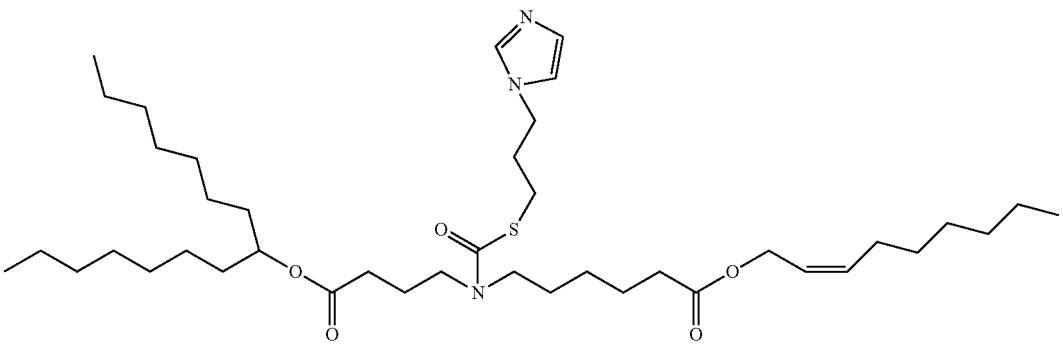 [SMILES: CCCCCC/C=C\COC(=O)CCCCCN(CCCC(=O)OC(CCCCCCC)CCCCCCC)C(=O)SCCCn1ccnc1] |

TABLE 10a-continued
| Ionized lipid number | Structure |
|---|---|
| 93 | 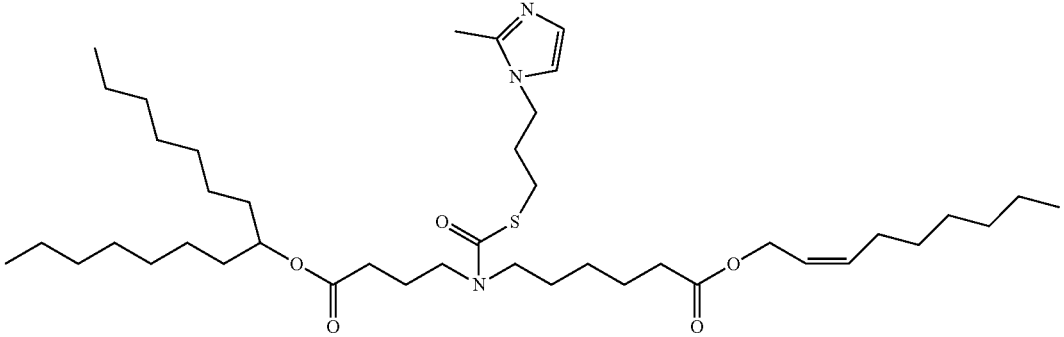 [SMILES: CCCCCC/C=C\COC(=O)CCCCCN(CCCC(=O)OC(CCCCCCC)CCCCCCC)C(=O)SCCCn1ccnc1C] |
| 94 | 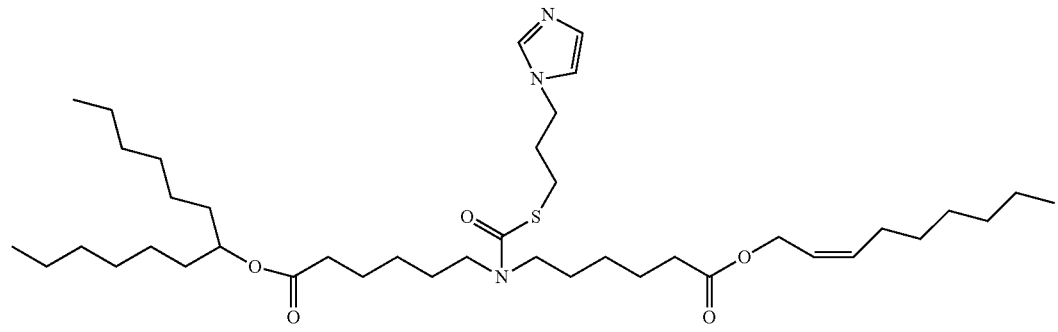 [SMILES: CCCCCC/C=C\COC(=O)CCCCCN(CCCCCC(=O)OC(CCCCCC)CCCCCC)C(=O)SCCCn1ccnc1] |
| 95 | 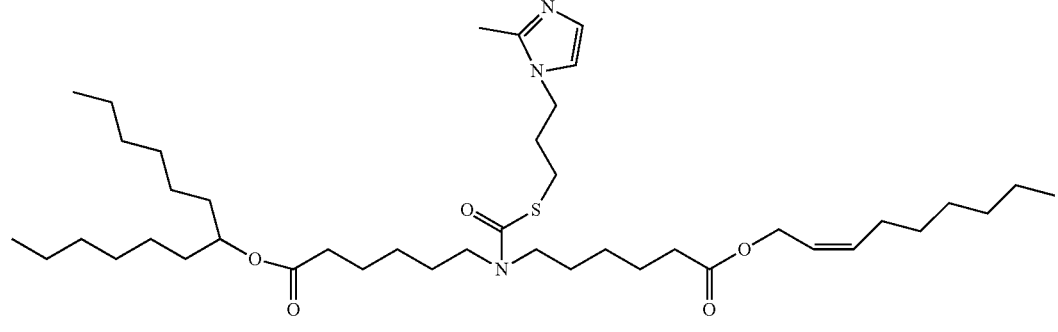 [SMILES: CCCCCC/C=C\COC(=O)CCCCCN(CCCCCC(=O)OC(CCCCCC)CCCCCC)C(=O)SCCCn1ccnc1C] |
| 96 | 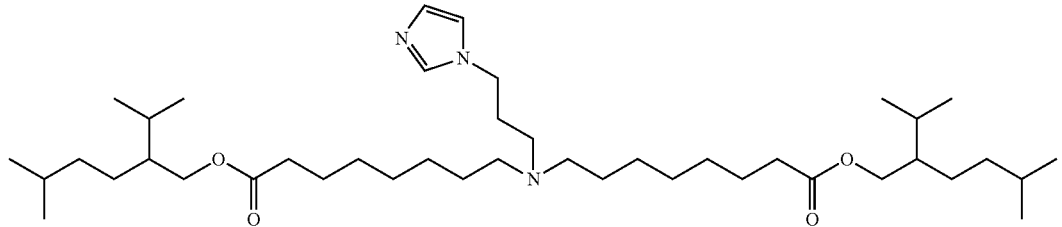 [SMILES: CC(C)CCC(COC(=O)CCCCCCCN(CCCCCCCC(=O)OCC(CCC(C)C)C(C)C)CCCn1ccnc1)C(C)C] |
| 97 | 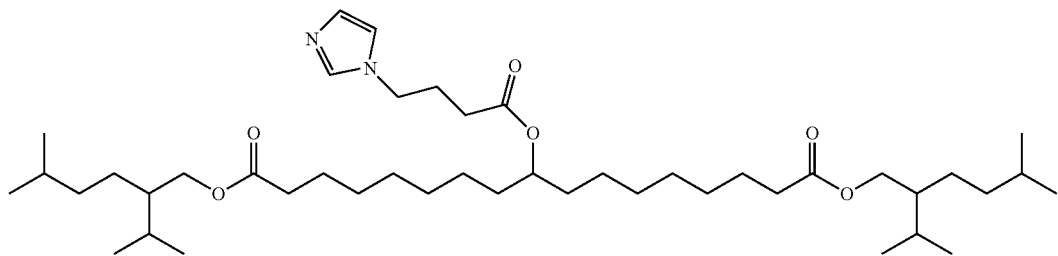 [SMILES: CC(C)CCC(COC(=O)CCCCCCCC(CCCCCCCC(=O)OCC(CCC(C)C)C(C)C)OC(=O)CCCn1ccnc1)C(C)C] |

TABLE 10a-continued
| Ionized lipid number | Structure |
|---|---|
| 98 | 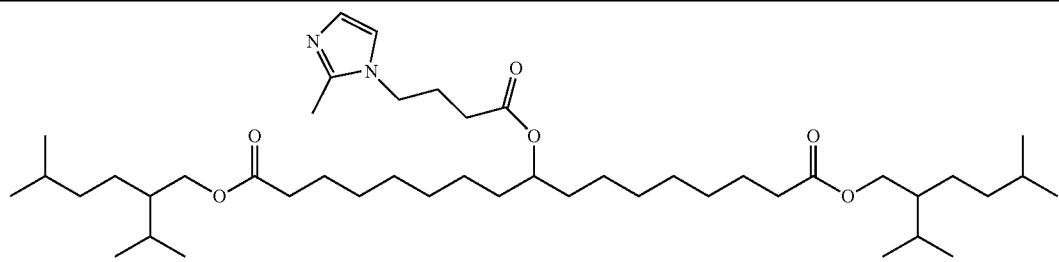 |
| 99 | 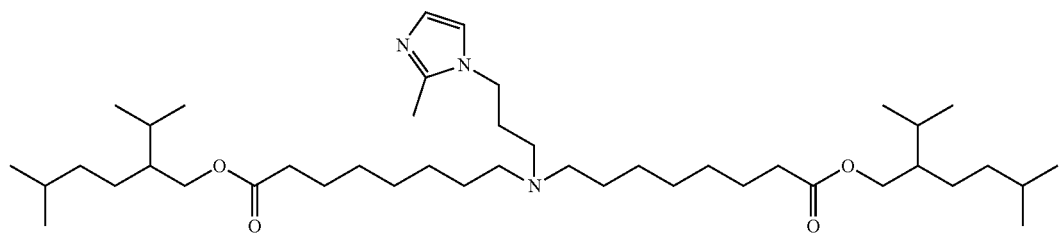 [SMILES: Cc1nccn1CCCN(CCCCCCCC(=O)OCC(CCC(C)C)C(C)C)CCCCCCCC(=O)OCC(CCC(C)C)C(C)C] |
| 100 | 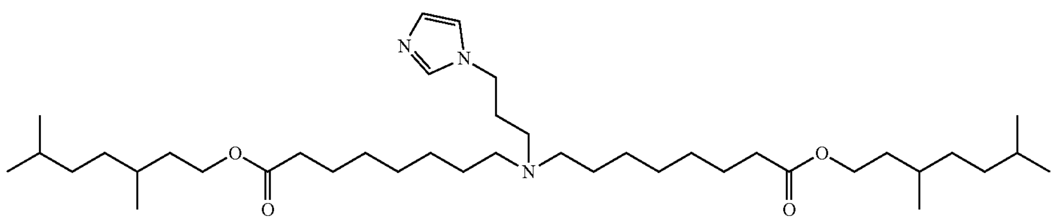 [SMILES: CC(C)CCC(C)CCOC(=O)CCCCCCCN(CCCCCCCC(=O)OCCC(C)CCC(C)C)CCCn1ccnc1] |
| 101 | 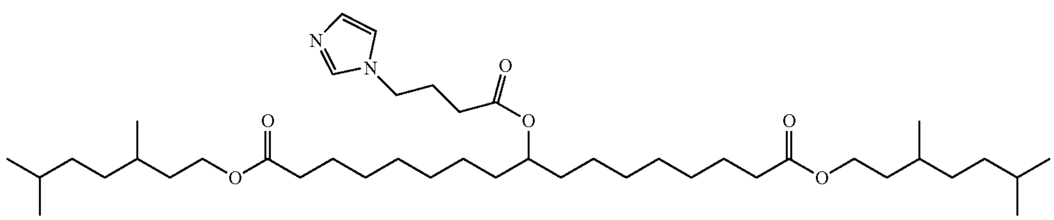 [SMILES: CC(C)CCC(C)CCOC(=O)CCCCCCCC(CCCCCCCC(=O)OCCC(C)CCC(C)C)OC(=O)CCCn1ccnc1] |
| 102 | 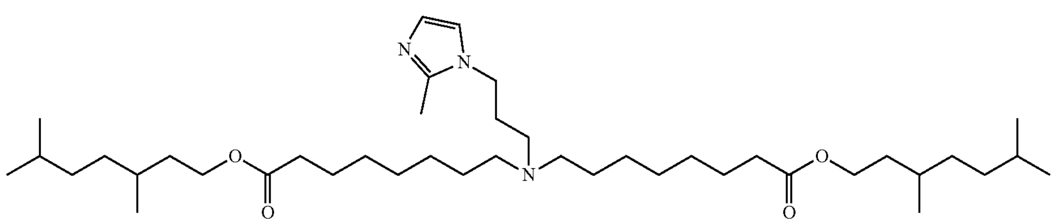 [SMILES: Cc1nccn1CCCN(CCCCCCCC(=O)OCCC(C)CCC(C)C)CCCCCCCC(=O)OCCC(C)CCC(C)C] |
| 103 | 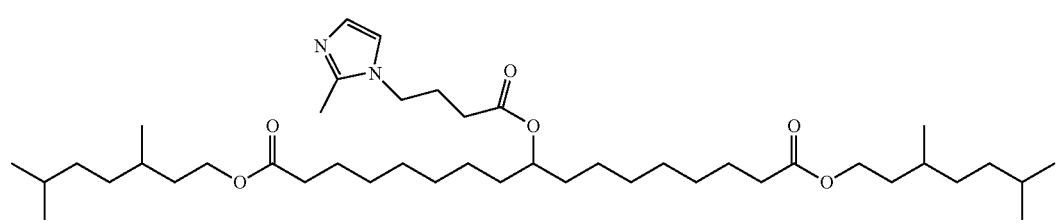 [SMILES: Cc1nccn1CCCC(=O)OC(CCCCCCCC(=O)OCCC(C)CCC(C)C)CCCCCCCC(=O)OCCC(C)CCC(C)C] |
| 104 | 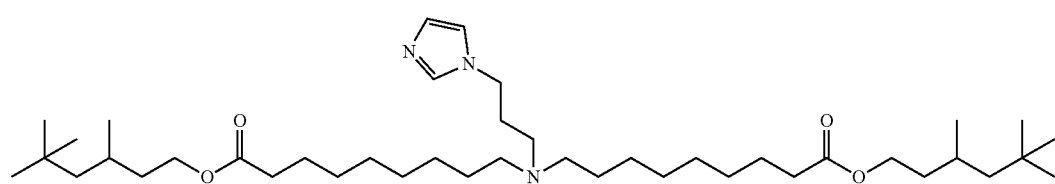 [SMILES: CC(CCOC(=O)CCCCCCCCN(CCCCCCCCC(=O)OCCC(C)CC(C)(C)C)CCCn1ccnc1)CC(C)(C)C] |

TABLE 10a-continued
| Ionized lipid number | Structure |
|---|---|
| 105 | 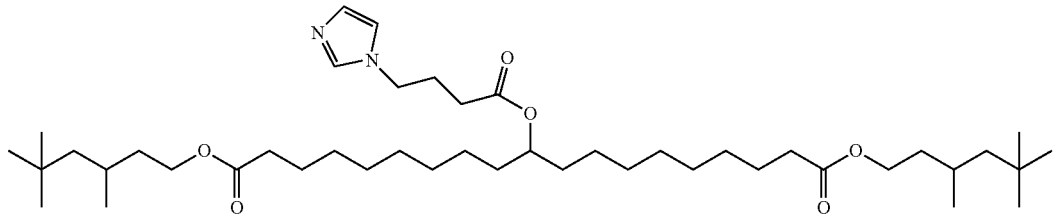 [SMILES: CC(CCOC(=O)CCCCCCCCC(CCCCCCCCC(=O)OCCC(C)CC(C)(C)C)OC(=O)CCCn1ccnc1)CC(C)(C)C] |
| 106 | 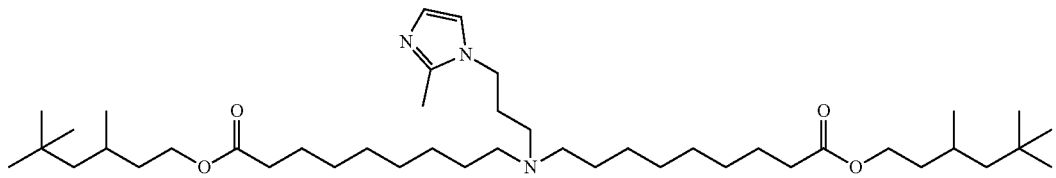 [SMILES: Cc1nccn1CCCN(CCCCCCCCC(=O)OCCC(C)CC(C)(C)C)CCCCCCCCC(=O)OCCC(C)CC(C)(C)C] |
| 107 | 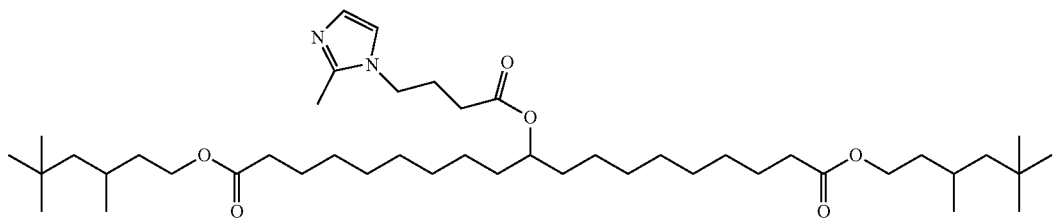 [SMILES: Cc1nccn1CCCC(=O)OC(CCCCCCCCC(=O)OCCC(C)CC(C)(C)C)CCCCCCCCC(=O)OCCC(C)CC(C)(C)C] |
| 108 | 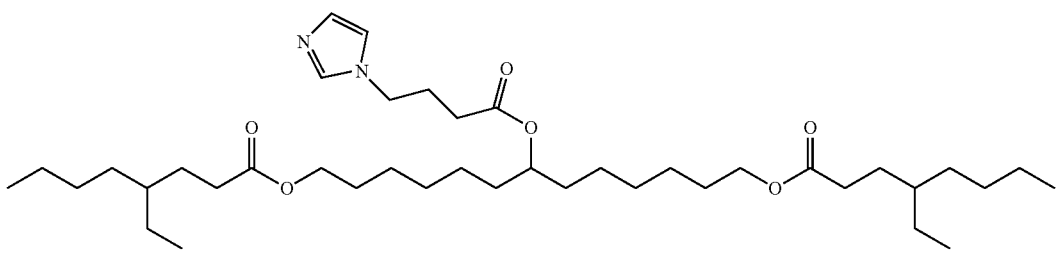 [SMILES: CCCCC(CC)CCC(=O)OCCCCCCC(CCCCCCOC(=O)CCC(CC)CCCC)OC(=O)CCCn1ccnc1] |
| 109 | 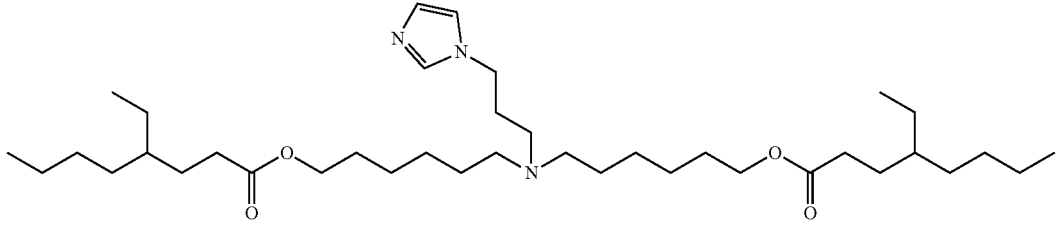 [SMILES: CCCCC(CC)CCC(=O)OCCCCCCN(CCCCCCOC(=O)CCC(CC)CCCC)CCCn1ccnc1] |
| 110 | 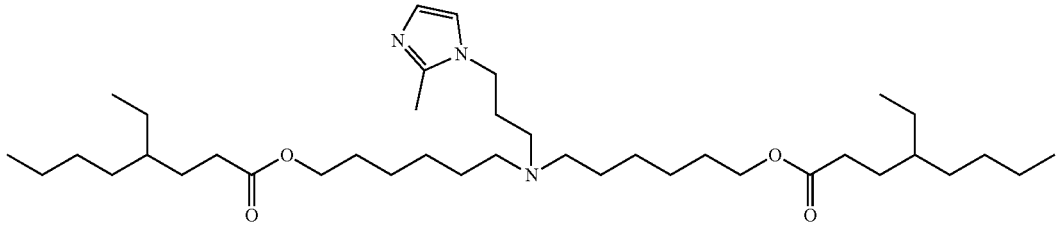 [SMILES: CCCCC(CC)CCC(=O)OCCCCCCN(CCCCCCOC(=O)CCC(CC)CCCC)CCCn1ccnc1C] |

TABLE 10a-continued
| Ionized lipid number | Structure |
|---|---|
| 111 | 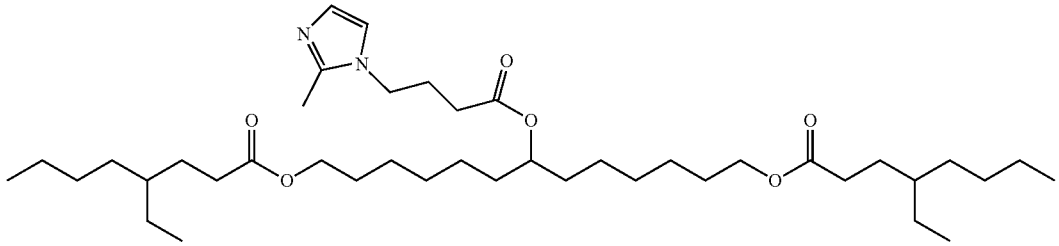 [SMILES: CCCCC(CC)CCC(=O)OCCCCCCC(CCCCCCOC(=O)CCC(CC)CCCC)OC(=O)CCCn1ccnc1C] |
| 112 | 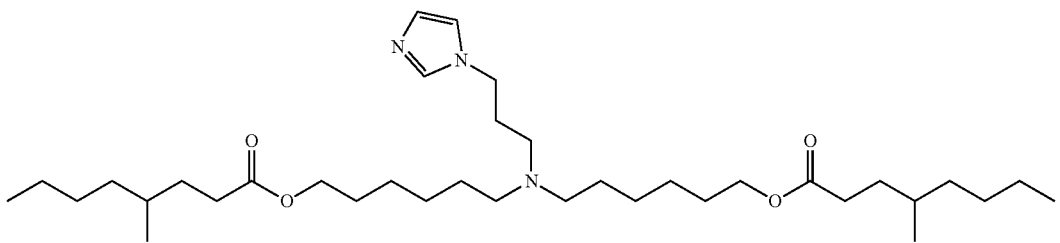 [SMILES: CCCCC(C)CCC(=O)OCCCCCCN(CCCCCCOC(=O)CCC(C)CCCC)CCCn1ccnc1] |
| 113 | 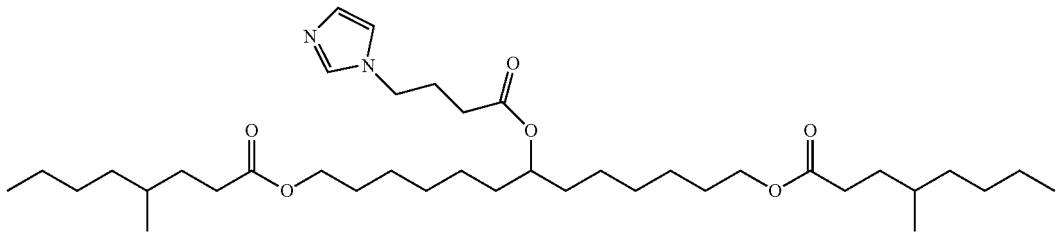 [SMILES: CCCCC(C)CCC(=O)OCCCCCCC(CCCCCCOC(=O)CCC(C)CCCC)OC(=O)CCCn1ccnc1] |
| 114 | 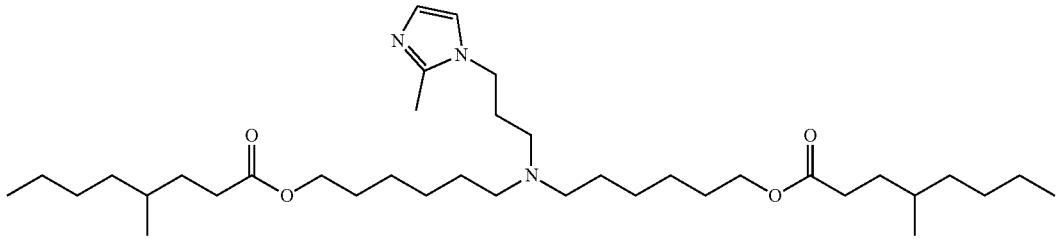 [SMILES: CCCCC(C)CCC(=O)OCCCCCCN(CCCCCCOC(=O)CCC(C)CCCC)CCCn1ccnc1C] |
| 115 | 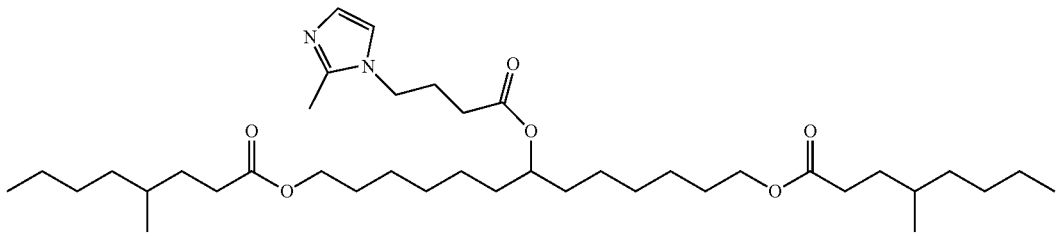 [SMILES: CCCCC(C)CCC(=O)OCCCCCCC(CCCCCCOC(=O)CCC(C)CCCC)OC(=O)CCCn1ccnc1C] |
| 116 | 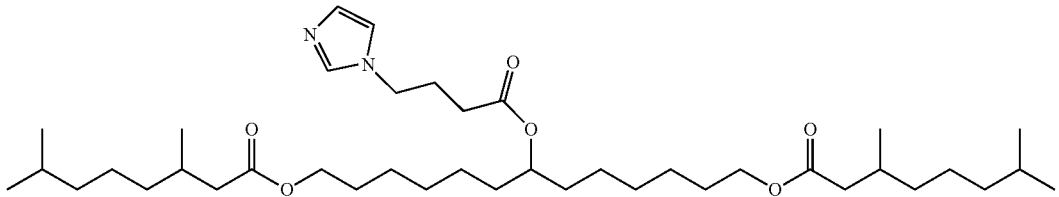 [SMILES: CC(C)CCCC(C)CC(=O)OCCCCCCC(CCCCCCOC(=O)CC(C)CCCC(C)C)OC(=O)CCCn1ccnc1] |

TABLE 10a-continued
| Ionized lipid number | Structure |
|---|---|
| 117 | 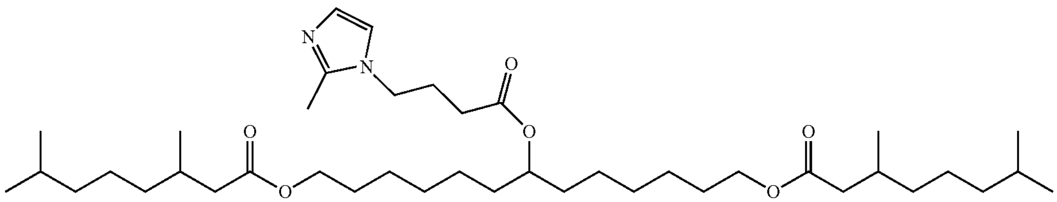 [SMILES: Cc1nccn1CCCC(=O)OC(CCCCCCOC(=O)CC(C)CCCC(C)C)CCCCCCOC(=O)CC(C)CCCC(C)C] |
| 118 | 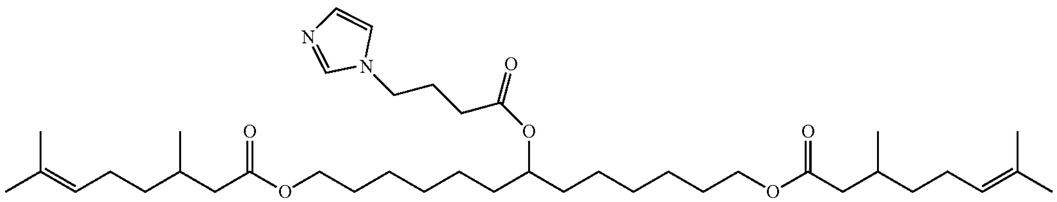 [SMILES: CC(C)=CCCC(C)CC(=O)OCCCCCCC(CCCCCCOC(=O)CC(C)CCC=C(C)C)OC(=O)CCCn1ccnc1] |
| 119 | 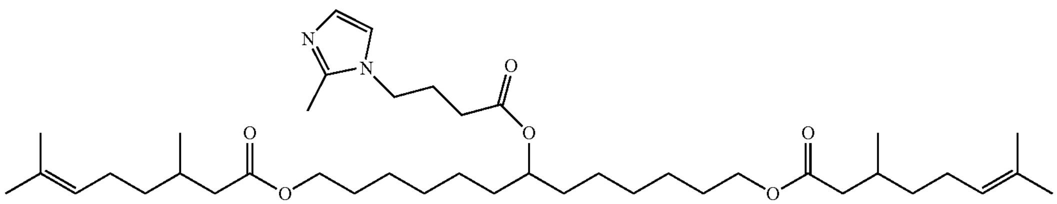 [SMILES: CC(C)=CCCC(C)CC(=O)OCCCCCCC(CCCCCCOC(=O)CC(C)CCC=C(C)C)OC(=O)CCCn1ccnc1C] |
| 120 | 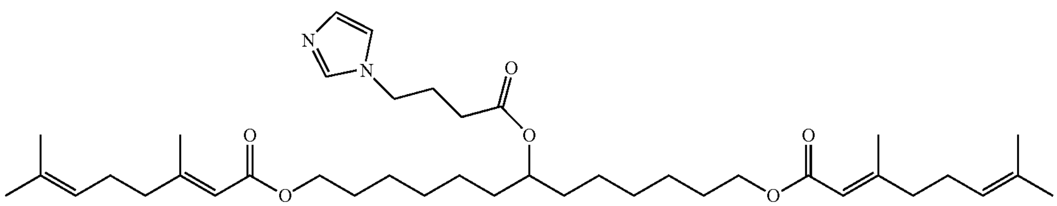 [SMILES: CC(C)=CCC/C(C)=C/C(=O)OCCCCCCC(CCCCCCOC(=O)/C=C(\C)CCC=C(C)C)OC(=O)CCCn1ccnc1] |
| 121 | 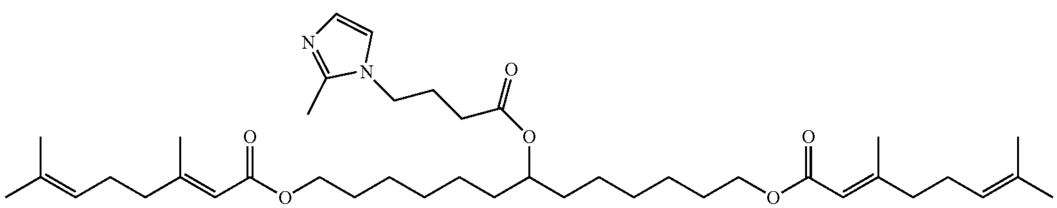 [SMILES: CC(C)=CCC/C(C)=C/C(=O)OCCCCCCC(CCCCCCOC(=O)/C=C(\C)CCC=C(C)C)OC(=O)CCCn1ccnc1C] |
| 122 | 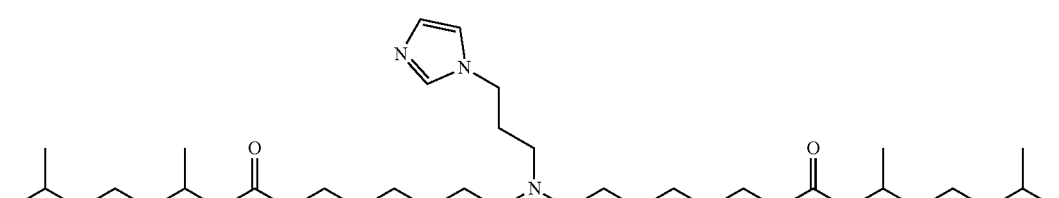 |
| 123 | 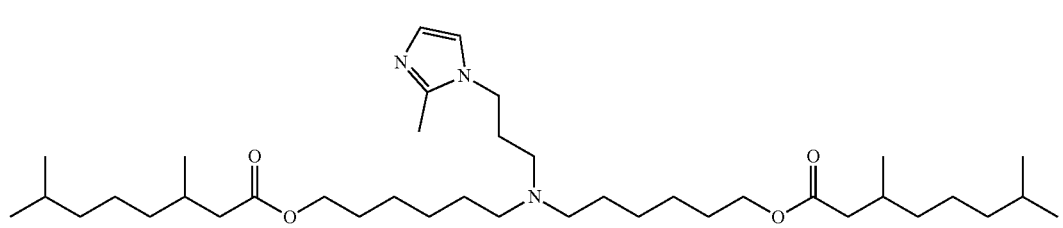 [SMILES: Cc1nccn1CCCN(CCCCCCOC(=O)CC(C)CCCC(C)C)CCCCCCOC(=O)CC(C)CCCC(C)C] |

TABLE 10a-continued
| Ionized lipid number | Structure |
|---|---|
| 124 | 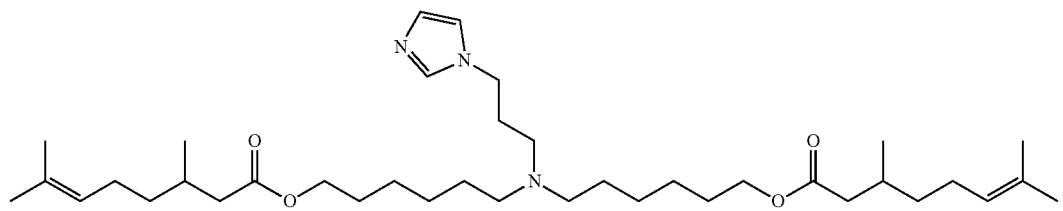 [SMILES: CC(C)=CCCC(C)CC(=O)OCCCCCCN(CCCCCCOC(=O)CC(C)CCC=C(C)C)CCCn1ccnc1] |
| 125 | 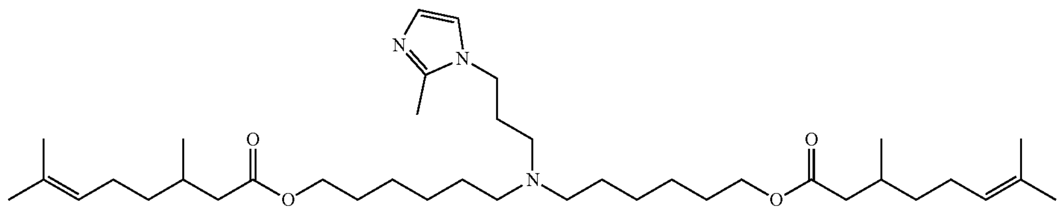 [SMILES: CC(C)=CCCC(C)CC(=O)OCCCCCCN(CCCCCCOC(=O)CC(C)CCC=C(C)C)CCCn1ccnc1C] |
| 126 | 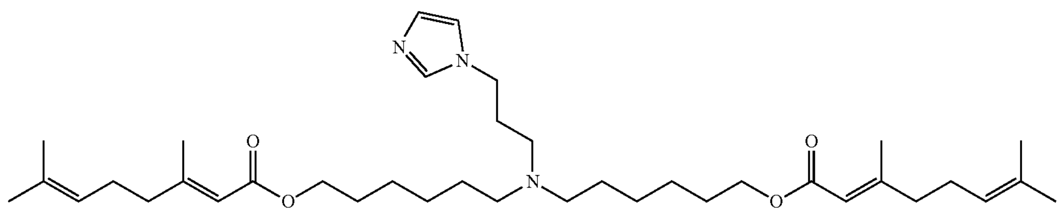 [SMILES: CC(C)=CCC/C(C)=C/C(=O)OCCCCCCN(CCCCCCOC(=O)/C=C(\C)CCC=C(C)C)CCCn1ccnc1] |
| 127 | 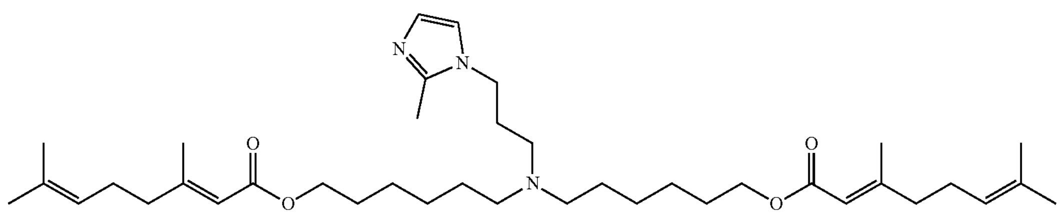 [SMILES: CC(C)=CCC/C(C)=C/C(=O)OCCCCCCN(CCCCCCOC(=O)/C=C(\C)CCC=C(C)C)CCCn1ccnc1C] |
| 128 | 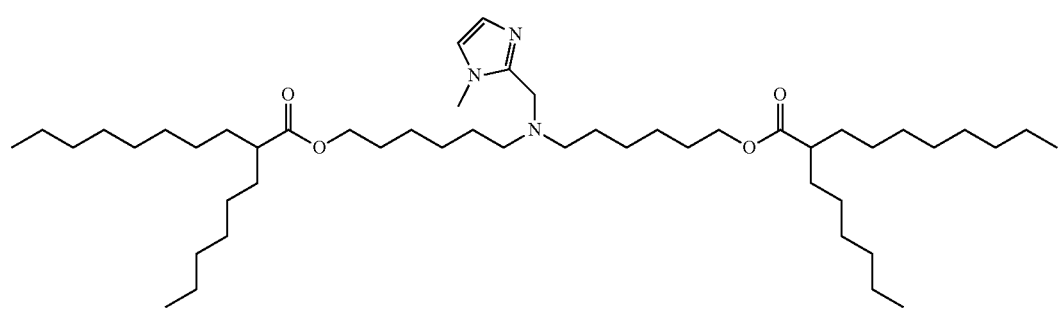 [SMILES: CCCCCCCCC(CCCCCC)C(=O)OCCCCCCN(CCCCCCOC(=O)C(CCCCCC)CCCCCCCC)Cc1nccn1C] |
| 129 | 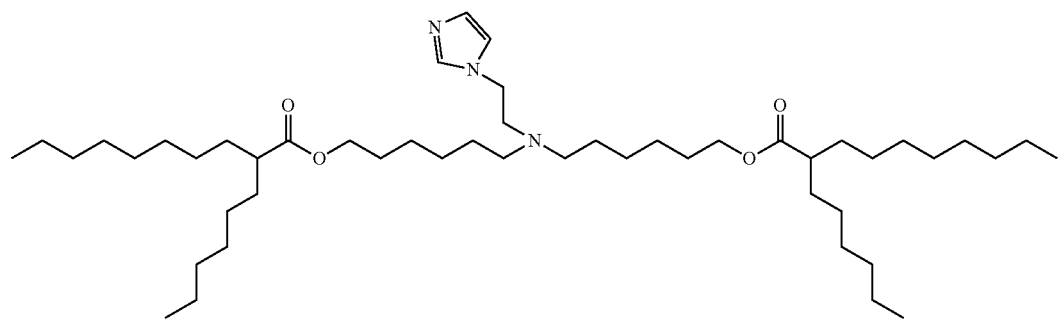 [SMILES: CCCCCCCCC(CCCCCC)C(=O)OCCCCCCN(CCCCCCOC(=O)C(CCCCCC)CCCCCCCC)CCn1ccnc1] |

TABLE 10a-continued
| Ionized lipid number | Structure |
|---|---|
| 130 | 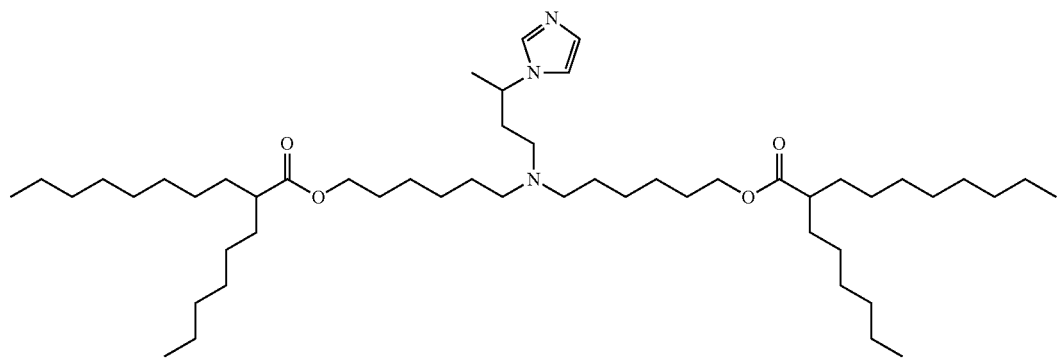 [SMILES: CCCCCCCCC(CCCCCC)C(=O)OCCCCCCN(CCCCCCOC(=O)C(CCCCCC)CCCCCCCC)CCC(C)n1ccnc1] |
| 131 | 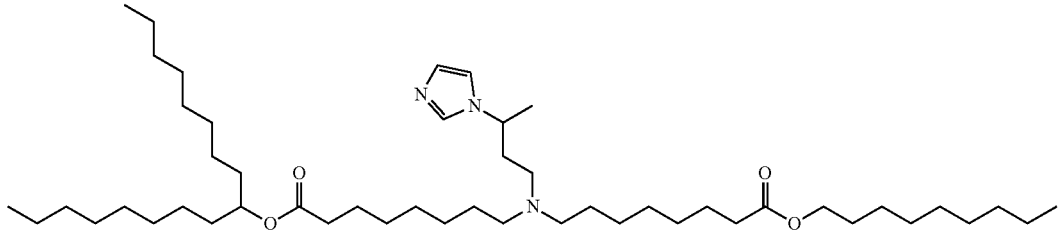 [SMILES: CCCCCCCCCOC(=O)CCCCCCCN(CCCCCCCC(=O)OC(CCCCCCCC)CCCCCCCC)CCC(C)n1ccnc1] |
| 132 | 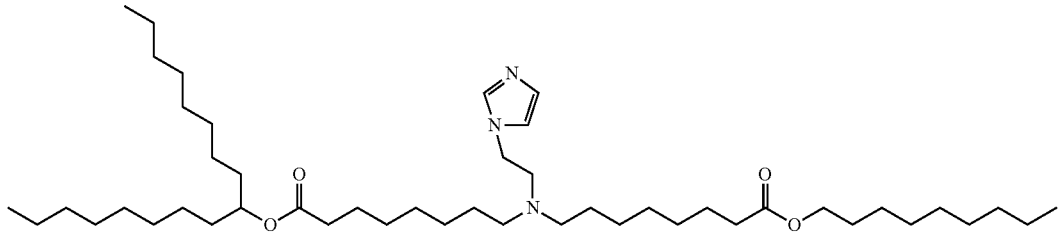 [SMILES: CCCCCCCCCOC(=O)CCCCCCCN(CCCCCCCC(=O)OC(CCCCCCCC)CCCCCCCC)CCn1ccnc1] |
| 133 | 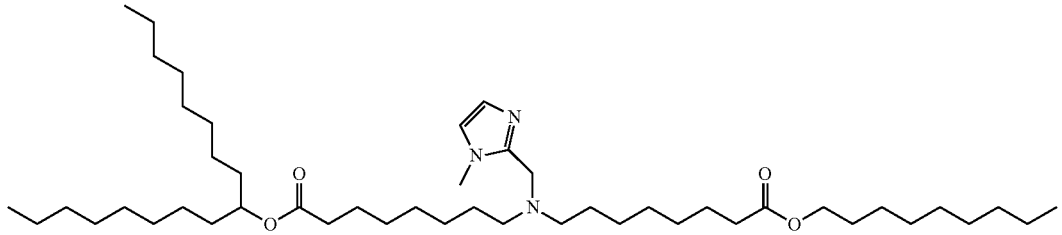 [SMILES: CCCCCCCCCOC(=O)CCCCCCCN(CCCCCCCC(=O)OC(CCCCCCCC)CCCCCCCC)Cc1nccn1C] |
| 134 | 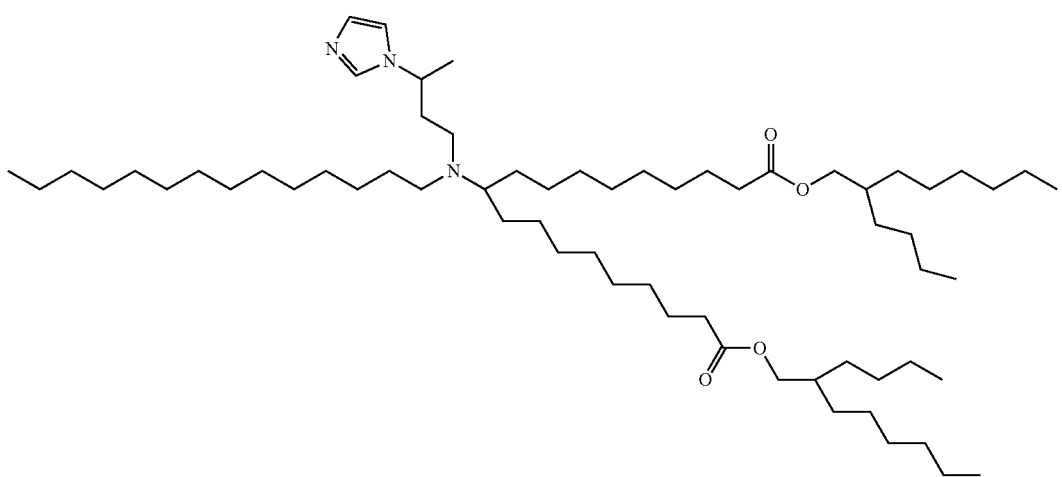 [SMILES: CCCCCCCCCCCCCCN(CCC(C)n1ccnc1)C(CCCCCCCCC(=O)OCC(CCCC)CCCCCC)CCCCCCCCC(=O)OCC(CCCC)CCCCCC] |

TABLE 10a-continued
| Ionized lipid number | Structure |
|---|---|
| 135 | 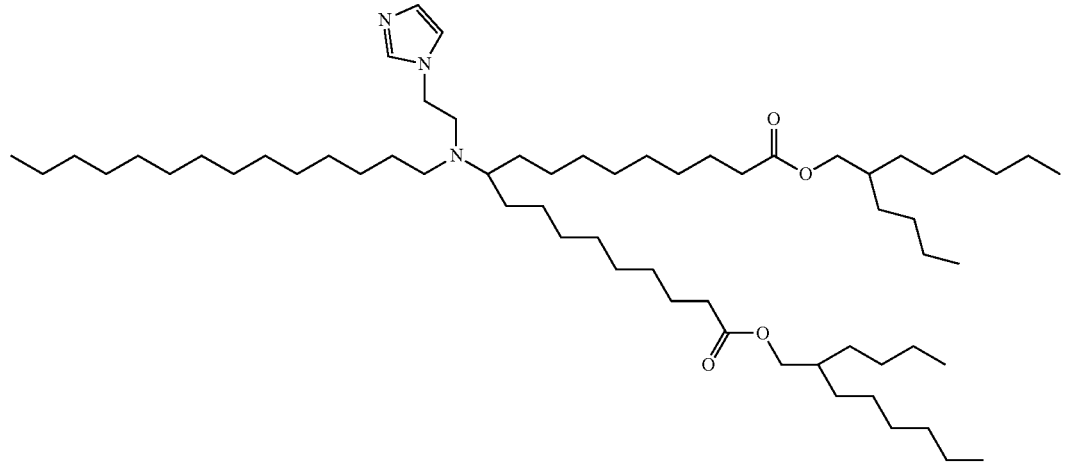 [SMILES: CCCCCCCCCCCCCCN(CCn1ccnc1)C(CCCCCCCCC(=O)OCC(CCCC)CCCCCC)CCCCCCCCC(=O)OCC(CCCC)CCCCCC] |
| 136 | 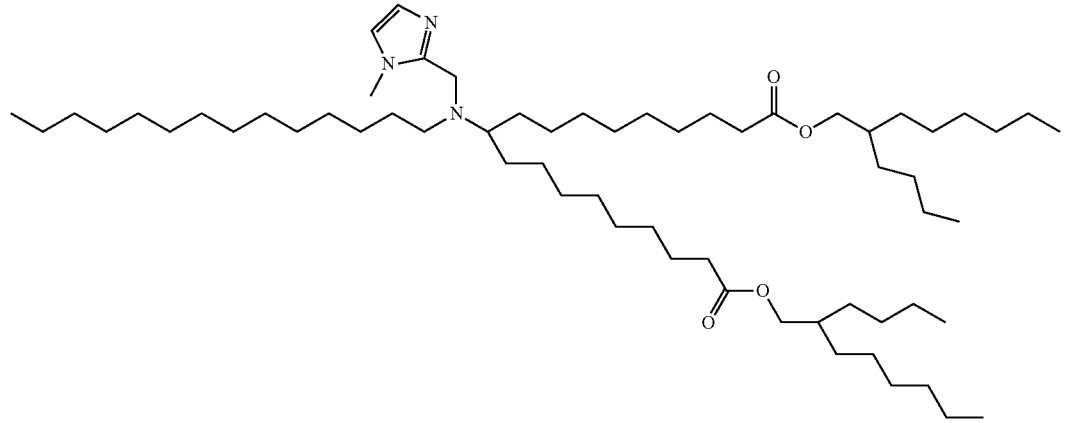 [SMILES: CCCCCCCCCCCCCCN(Cc1nccn1C)C(CCCCCCCCC(=O)OCC(CCCC)CCCCCC)CCCCCCCCC(=O)OCC(CCCC)CCCCCC] |
| 137 | 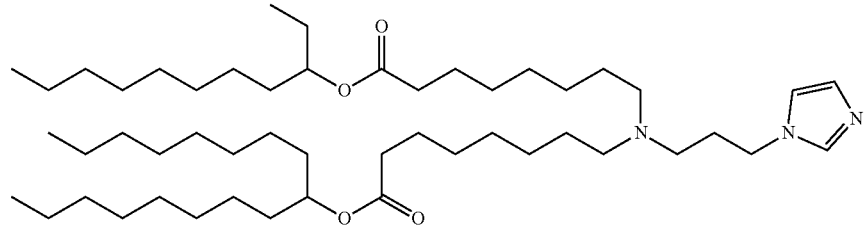 [SMILES: CCCCCCCCC(CC)OC(=O)CCCCCCCN(CCCCCCCC(=O)OC(CCCCCCCC)CCCCCCCC)CCCn1ccnc1] |
| 138 | 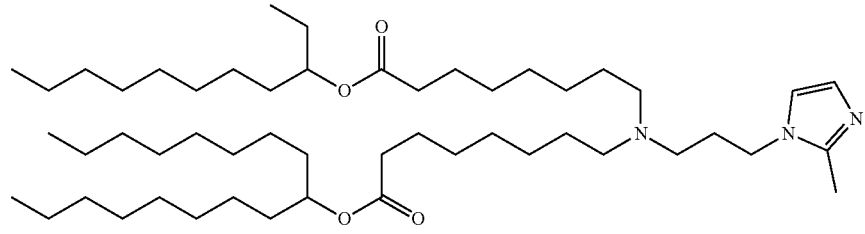 [SMILES: CCCCCCCCC(CC)OC(=O)CCCCCCCN(CCCCCCCC(=O)OC(CCCCCCCC)CCCCCCCC)CCCn1ccnc1C] |

TABLE 10a-continued
| Ionized lipid number | Structure |
|---|---|
| 139 | 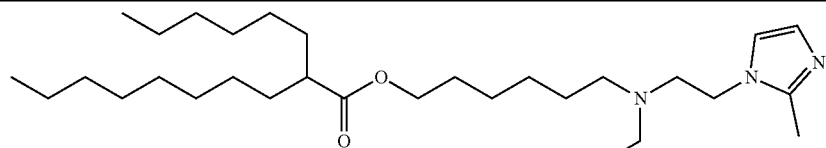 |
| 140 | 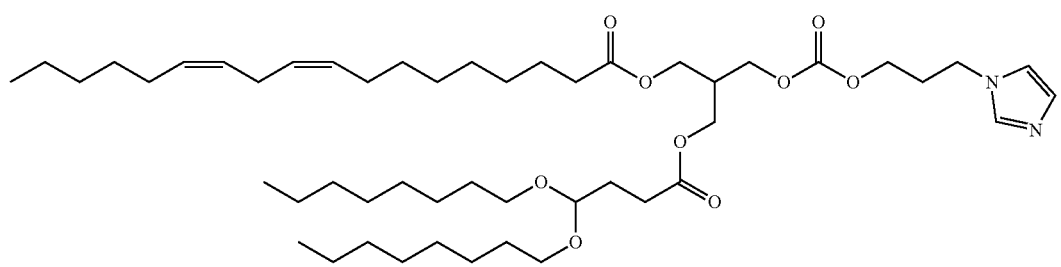 [SMILES: CCCCC/C=C\C/C=C\CCCCCCCC(=O)OCC(COC(=O)CCC(OCCCCCCCC)OCCCCCCCC)COC(=O)OCCCn1ccnc1] |
| 141 | 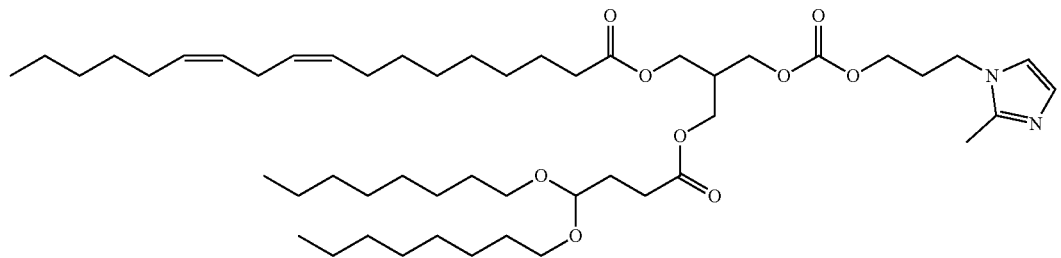 [SMILES: CCCCC/C=C\C/C=C\CCCCCCCC(=O)OCC(COC(=O)CCC(OCCCCCCCC)OCCCCCCCC)COC(=O)OCCCn1ccnc1C] |
| 142 | 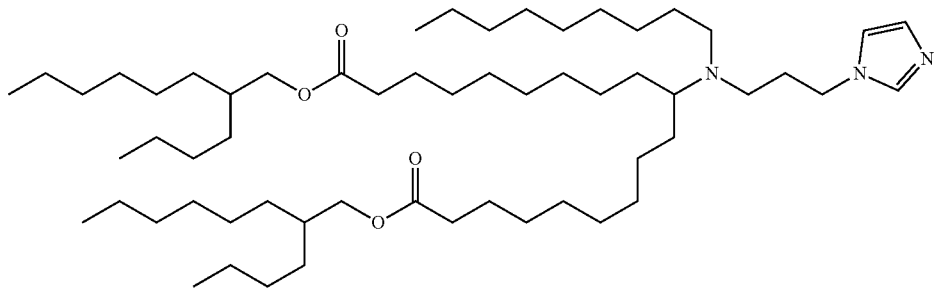 [SMILES: CCCCCCCCCN(CCCn1ccnc1)C(CCCCCCCCC(=O)OCC(CCCC)CCCCCC)CCCCCCCCC(=O)OCC(CCCC)CCCCCC] |
| 143 | 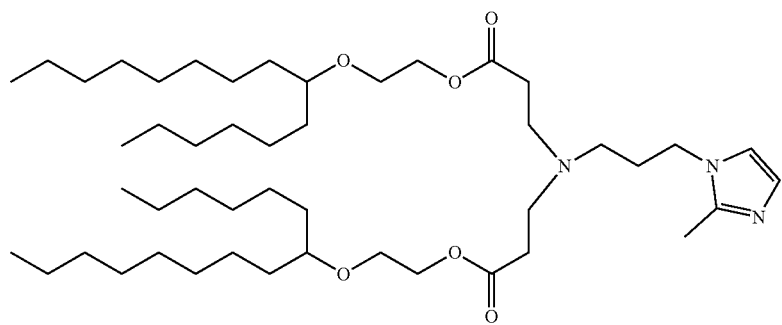 [SMILES: CCCCCCCCC(CCCCCC)OCCOC(=O)CCN(CCCn1ccnc1C)CCC(=O)OCCOC(CCCCCC)CCCCCCCC] |

TABLE 10a-continued
| Ionized lipid number | Structure |
|---|---|
| 144 | 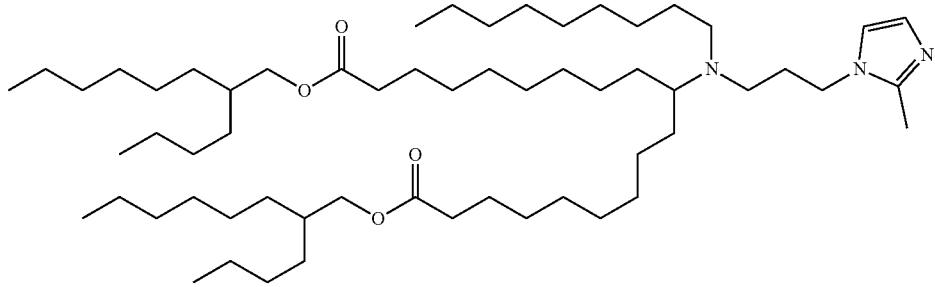 [SMILES: CCCCCCCCCN(CCCn1ccnc1C)C(CCCCCCCCC(=O)OCC(CCCC)CCCCCC)CCCCCCCCC(=O)OCC(CCCC)CCCCCC] |
| 145 | 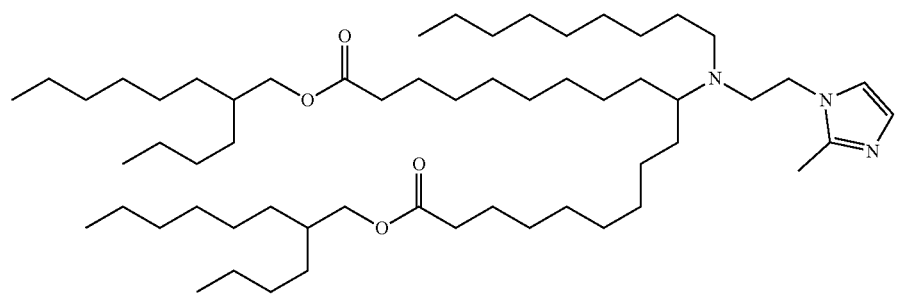 [SMILES: CCCCCCCCCN(CCn1ccnc1C)C(CCCCCCCCC(=O)OCC(CCCC)CCCCCC)CCCCCCCCC(=O)OCC(CCCC)CCCCCC] |
| 146 | 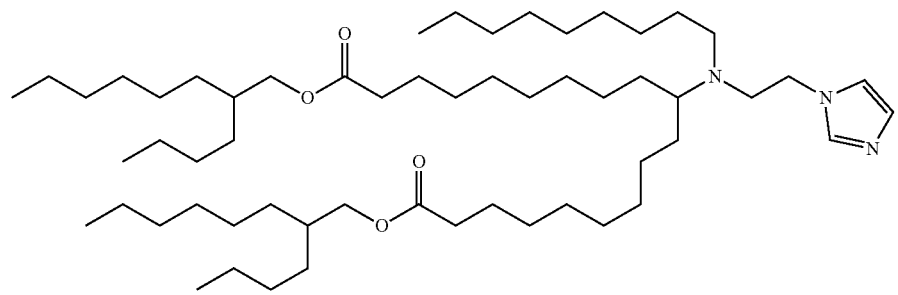 [SMILES: CCCCCCCCCN(CCn1ccnc1)C(CCCCCCCCC(=O)OCC(CCCC)CCCCCC)CCCCCCCCC(=O)OCC(CCCC)CCCCCC] |
| 147 | 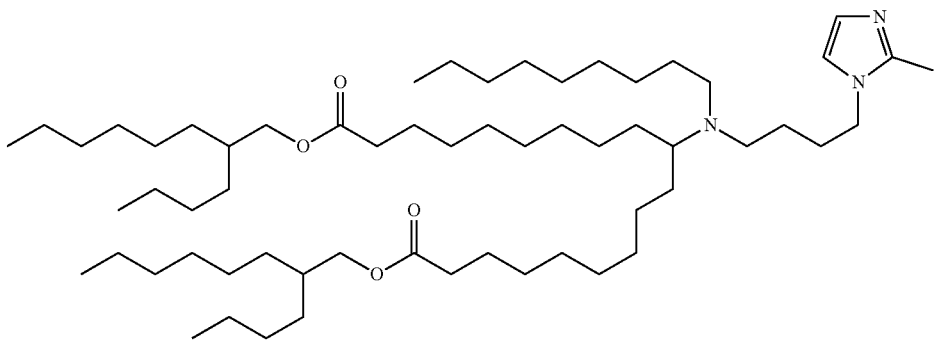 [SMILES: CCCCCCCCCN(CCCCn1ccnc1C)C(CCCCCCCCC(=O)OCC(CCCC)CCCCCC)CCCCCCCCC(=O)OCC(CCCC)CCCCCC] |
| 148 | 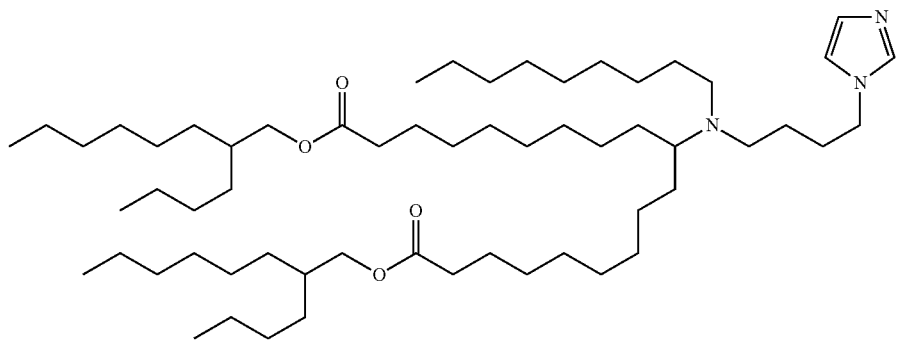 [SMILES: CCCCCCCCCN(CCCCn1ccnc1)C(CCCCCCCCC(=O)OCC(CCCC)CCCCCC)CCCCCCCCC(=O)OCC(CCCC)CCCCCC] |

TABLE 10a-continued

| Ionized lipid number | Structure |
|---|---|
| 149 | 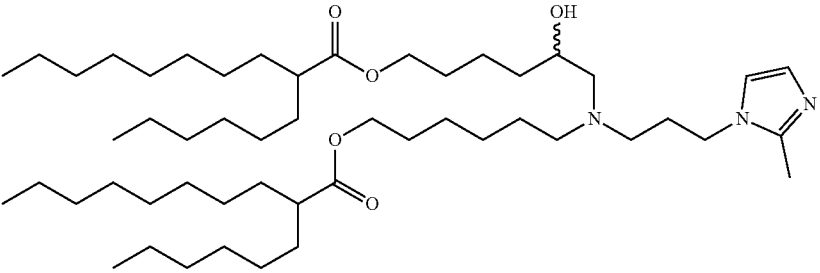 [SMILES: CCCCCCCCC(CCCCCC)C(=O)OCCCCCCN(CCCn1ccnc1C)CC(O)CCCCOC(=O)C(CCCCCC)CCCCCCCC] |
| 150 | 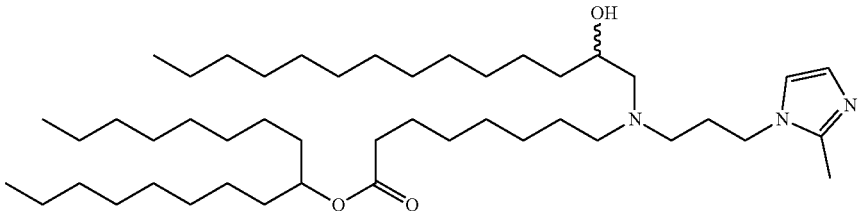 [SMILES: CCCCCCCCCCCCC(O)CN(CCCCCCCC(=O)OC(CCCCCCCC)CCCCCCCC)CCCn1ccnc1C] |
| 151 | |

In some embodiments, the ionizable lipid has a beta-hydroxyl amine head group. In some embodiments, the ionizable lipid has a gamma-hydroxyl amine head group.

In some embodiments, an ionizable lipid of the disclosure is a lipid selected from Table 10b. In some embodiments, an ionizable lipid of the disclosure is Lipid 15 from Table 10b. In an embodiment, the ionizable lipid is described in US patent publication number US20170210697A1. In an embodiment, the ionizable lipid is described in US patent publication number US20170119904A1.

TABLE 10b

| Ionizable lipid number | Structure |
|---|---|
| 1 | 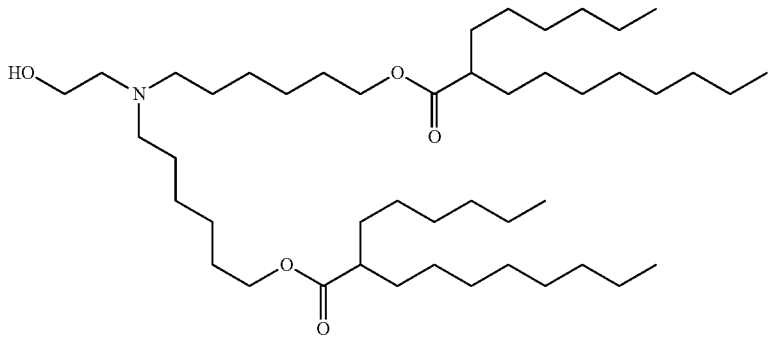 [SMILES: CCCCCCCCC(CCCCCC)C(=O)OCCCCCCN(CCO)CCCCCCOC(=O)C(CCCCCC)CCCCCCCC] |
| 2 | 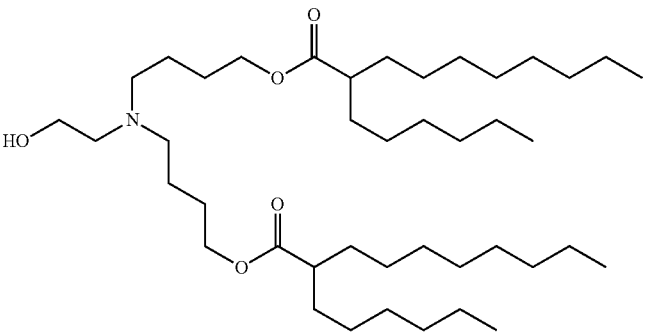 [SMILES: CCCCCCCCC(CCCCCC)C(=O)OCCCCN(CCO)CCCCOC(=O)C(CCCCCC)CCCCCCCC] |

TABLE 10b-continued
| Ionizable lipid number | Structure |
|---|---|
| 3 | 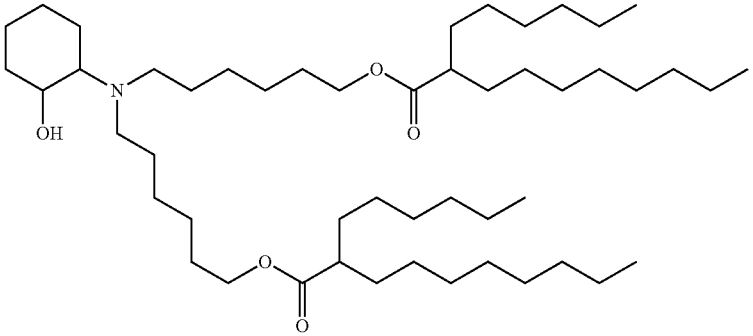 [SMILES: CCCCCCCCC(CCCCCC)C(=O)OCCCCCCN(CCCCCCOC(=O)C(CCCCCC)CCCCCCCC)C1CCCCC1O] |
| 4 | 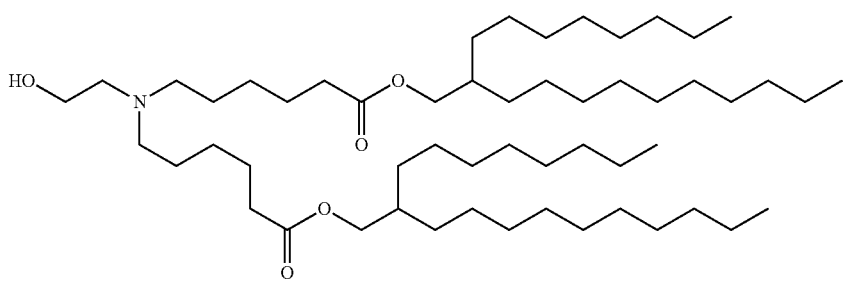 [SMILES: CCCCCCCCCCC(CCCCCCCC)COC(=O)CCCCCN(CCO)CCCCCC(=O)OCC(CCCCCCCC)CCCCCCCCCC] |
| 5 | 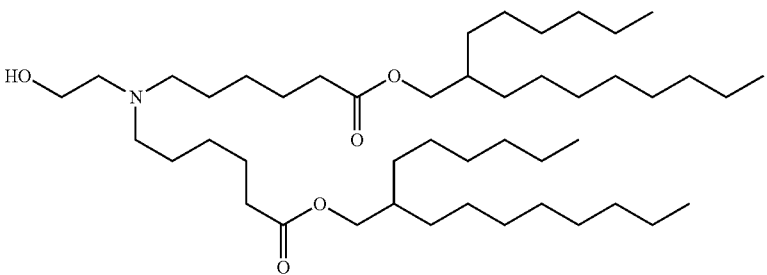 [SMILES: CCCCCCCCC(CCCCCC)COC(=O)CCCCCN(CCO)CCCCCC(=O)OCC(CCCCCC)CCCCCCCC] |
| 6 | 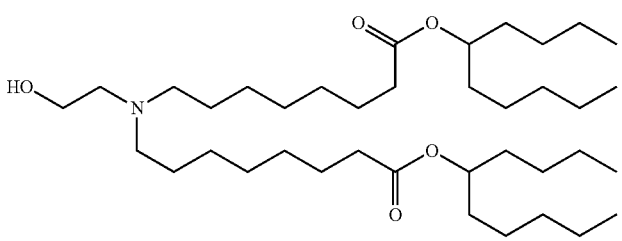 [SMILES: CCCCCC(CCCC)OC(=O)CCCCCCCN(CCO)CCCCCCCC(=O)OC(CCCC)CCCCC] |
| 7 | 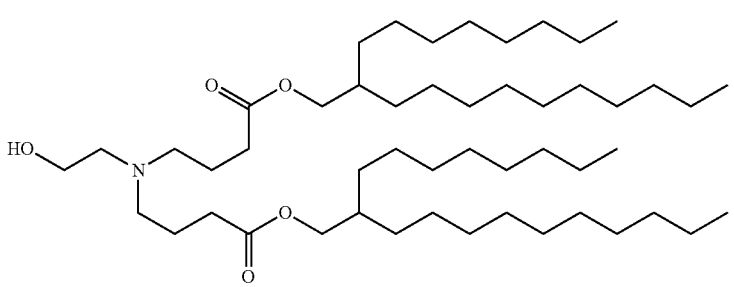 [SMILES: CCCCCCCCCCC(CCCCCCCC)COC(=O)CCCN(CCO)CCCC(=O)OCC(CCCCCCCC)CCCCCCCCCC] |

TABLE 10b-continued
| Ionizable lipid number | Structure |
|---|---|
| 8 | 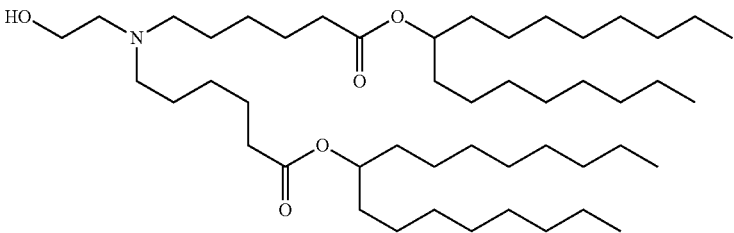 [SMILES: CCCCCCCCC(CCCCCCCC)OC(=O)CCCCCN(CCO)CCCCCC(=O)OC(CCCCCCCC)CCCCCCCC] |
| 9 | 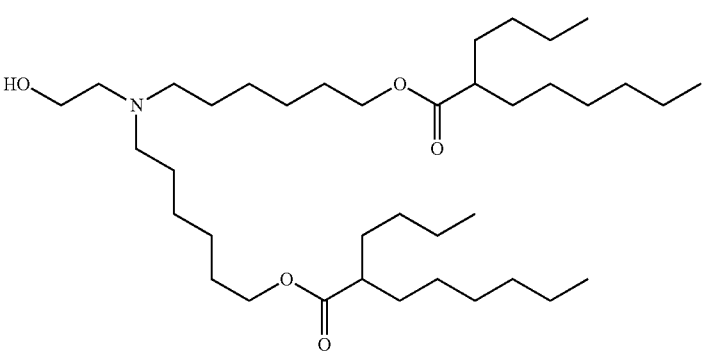 [SMILES: CCCCCCC(CCCC)C(=O)OCCCCCCN(CCO)CCCCCCOC(=O)C(CCCC)CCCCCC] |
| 10 | 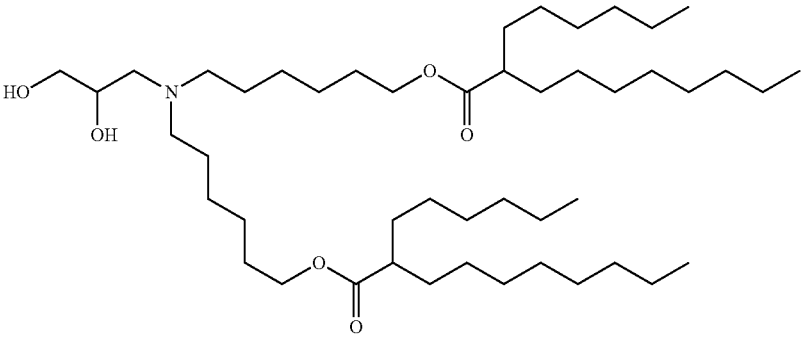 |
| 11 | 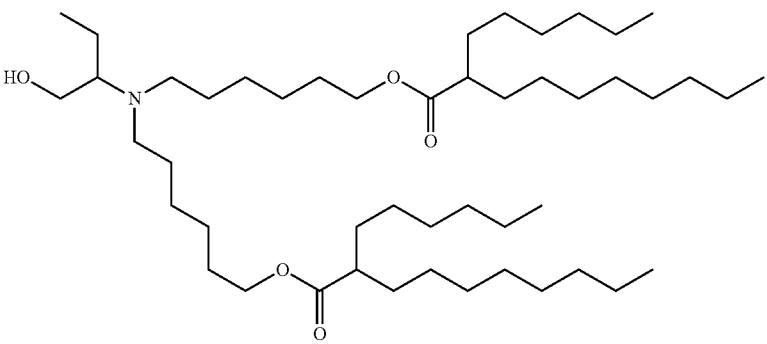 [SMILES: CCCCCCCCC(CCCCCC)C(=O)OCCCCCCN(CCCCCCOC(=O)C(CCCCCC)CCCCCCCC)C(CC)CO] |

TABLE 10b-continued
| Ionizable lipid number | Structure |
|---|---|
| 12 | 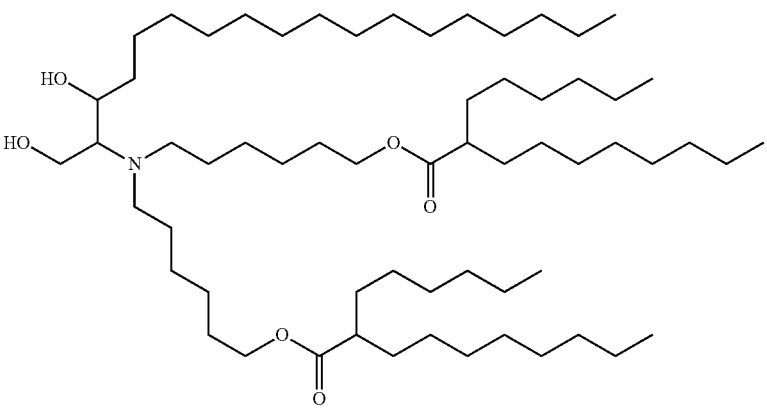 [SMILES: CCCCCCCCCCCCCCCC(O)C(CO)N(CCCCCCOC(=O)C(CCCCCC)CCCCCCCC)CCCCCCOC(=O)C(CCCCCC)CCCCCCCC] |
| 13 | 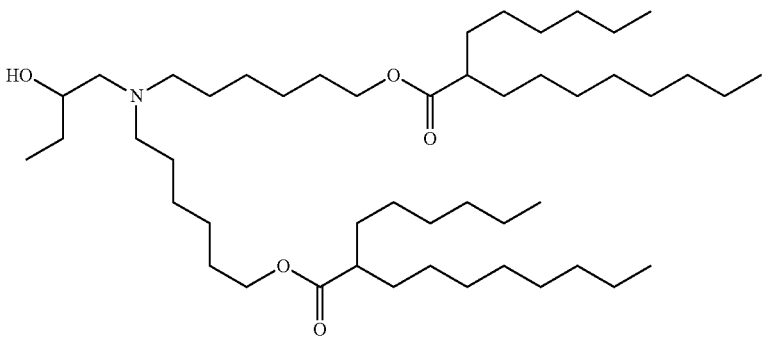 [SMILES: CCCCCCCCC(CCCCCC)C(=O)OCCCCCCN(CCCCCCOC(=O)C(CCCCCC)CCCCCCCC)CC(O)CC] |
| 14 | 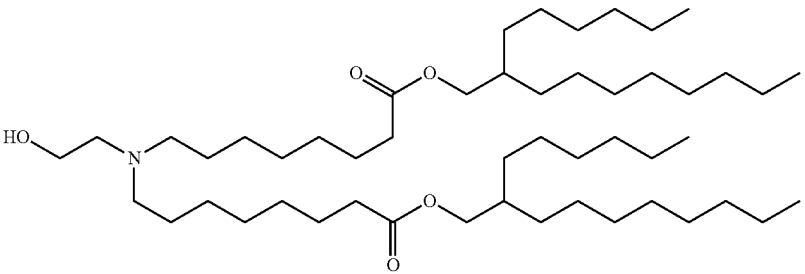 [SMILES: CCCCCCCCC(CCCCCC)COC(=O)CCCCCCCN(CCO)CCCCCCCC(=O)OCC(CCCCCC)CCCCCCCC] |
| 15 | 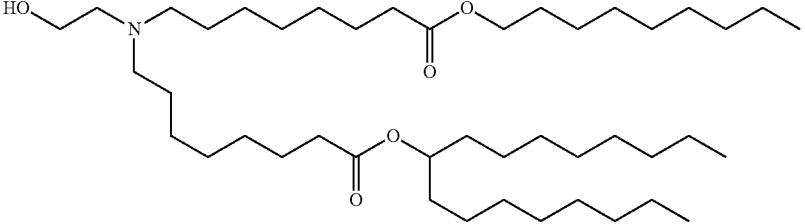 [SMILES: CCCCCCCCCOC(=O)CCCCCCCN(CCO)CCCCCCCC(=O)OC(CCCCCCCC)CCCCCCCC] |

TABLE 10b-continued

| Ionizable lipid number | Structure |
| --- | --- |
| 16 | 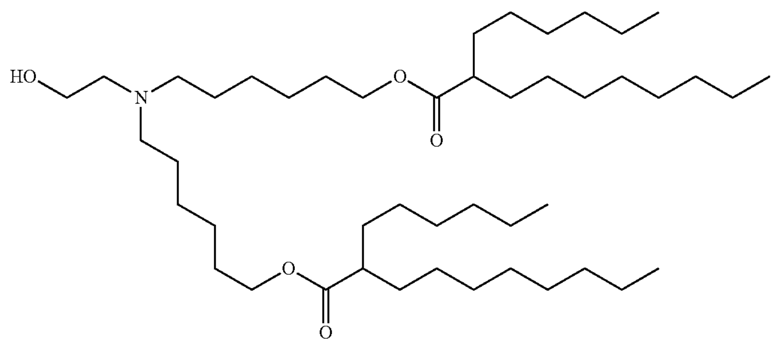 [SMILES: CCCCCCCCC(CCCCCC)C(=O)OCCCCCCN(CCO)CCCCCCOC(=O)C(CCCCCC)CCCCCCCC] |
| 17 | 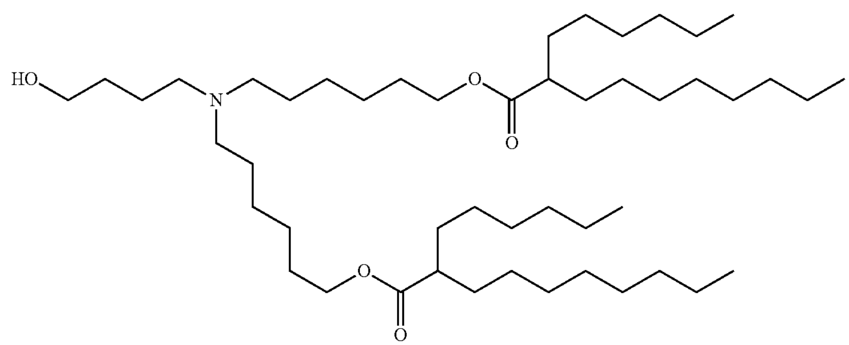 [SMILES: CCCCCCCCC(CCCCCC)C(=O)OCCCCCCN(CCCCO)CCCCCCOC(=O)C(CCCCCC)CCCCCCCC] |
| 18 | 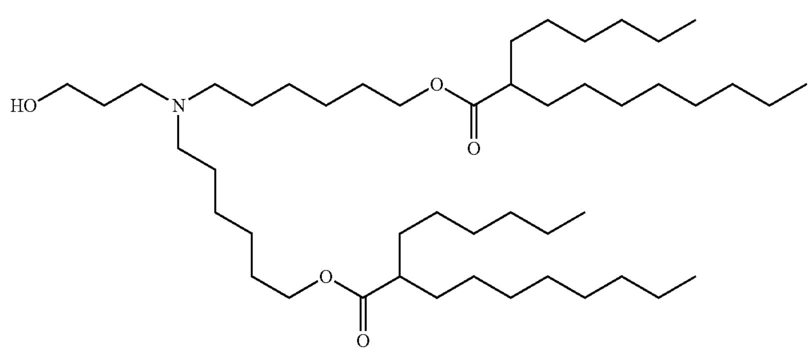 [SMILES: CCCCCCCCC(CCCCCC)C(=O)OCCCCCCN(CCCO)CCCCCCOC(=O)C(CCCCCC)CCCCCCCC] |
| 19 | 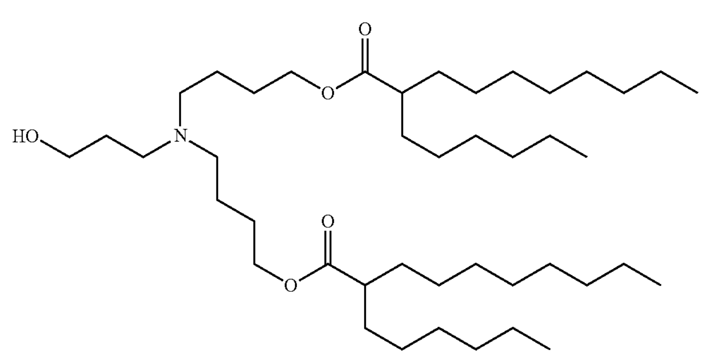 [SMILES: CCCCCCCCC(CCCCCC)C(=O)OCCCCN(CCCO)CCCCOC(=O)C(CCCCCC)CCCCCCCC] |

TABLE 10b-continued

| Ionizable lipid number | Structure |
|---|---|
| 20 | 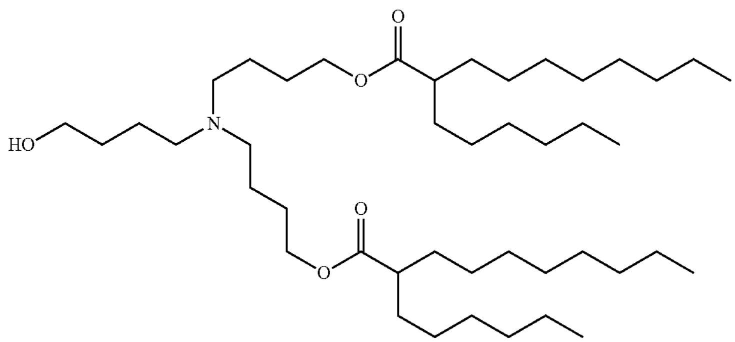 [SMILES: CCCCCCCCC(CCCCCC)C(=O)OCCCCN(CCCCO)CCCCOC(=O)C(CCCCCC)CCCCCCCC] |
| 21 | 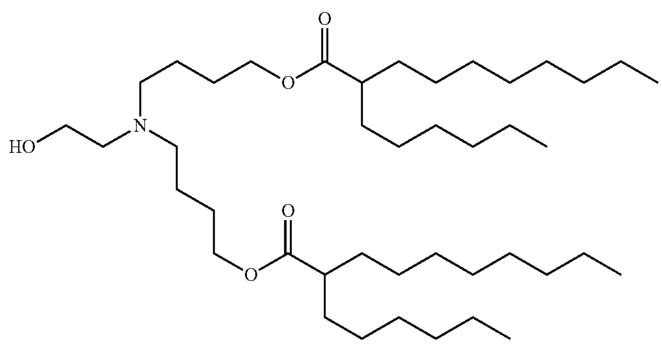 [SMILES: CCCCCCCCC(CCCCCC)C(=O)OCCCCN(CCO)CCCCOC(=O)C(CCCCCC)CCCCCCCC] |
| 22 | 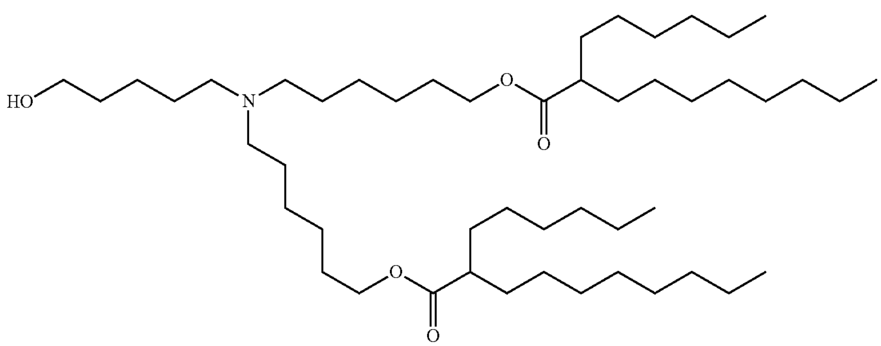 [SMILES: CCCCCCCCC(CCCCCC)C(=O)OCCCCCCN(CCCCCO)CCCCCCOC(=O)C(CCCCCC)CCCCCCCC] |
| 23 | 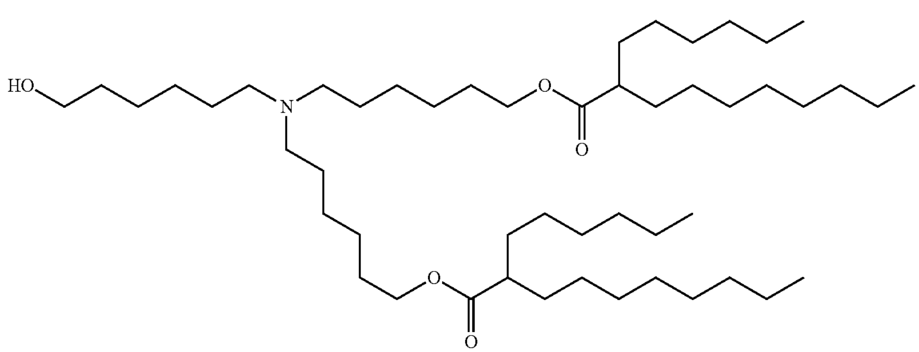 [SMILES: CCCCCCCCC(CCCCCC)C(=O)OCCCCCCN(CCCCCCO)CCCCCCOC(=O)C(CCCCCC)CCCCCCCC] |

TABLE 10b-continued

| Ionizable lipid number | Structure |
|---|---|
| 24 | 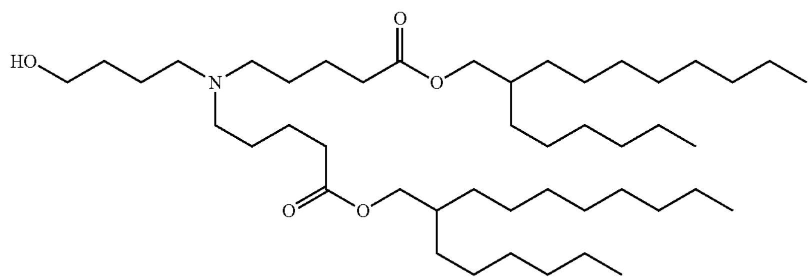 [SMILES: CCCCCCCCC(CCCCCC)COC(=O)CCCCN(CCCCO)CCCCC(=O)OCC(CCCCCC)CCCCCCCC] |
| 25 | 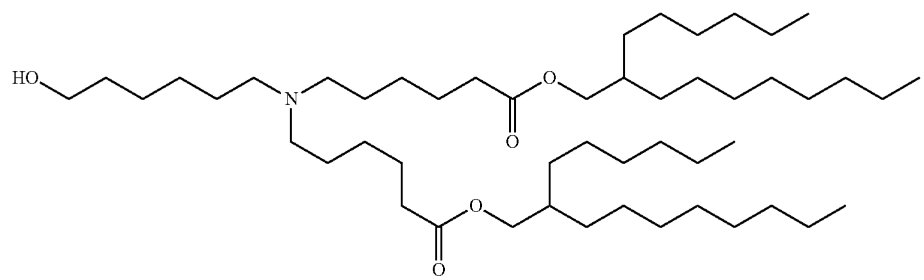 [SMILES: CCCCCCCCC(CCCCCC)COC(=O)CCCCCN(CCCCCCO)CCCCCC(=O)OCC(CCCCCC)CCCCCCCC] |
| 26 | 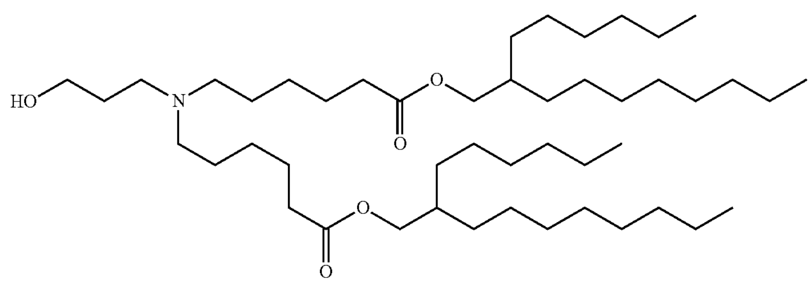 [SMILES: CCCCCCCCC(CCCCCC)COC(=O)CCCCCN(CCCO)CCCCCC(=O)OCC(CCCCCC)CCCCCCCC] |
| 27 | 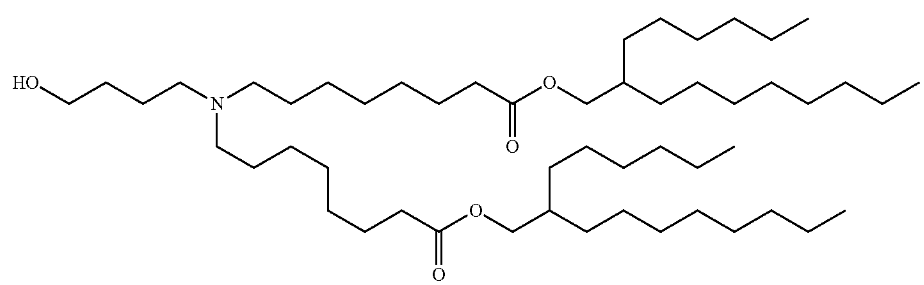 [SMILES: CCCCCCCCC(CCCCCC)COC(=O)CCCCCCCN(CCCCO)CCCCCCCC(=O)OCC(CCCCCC)CCCCCCCC] |
| 28 | 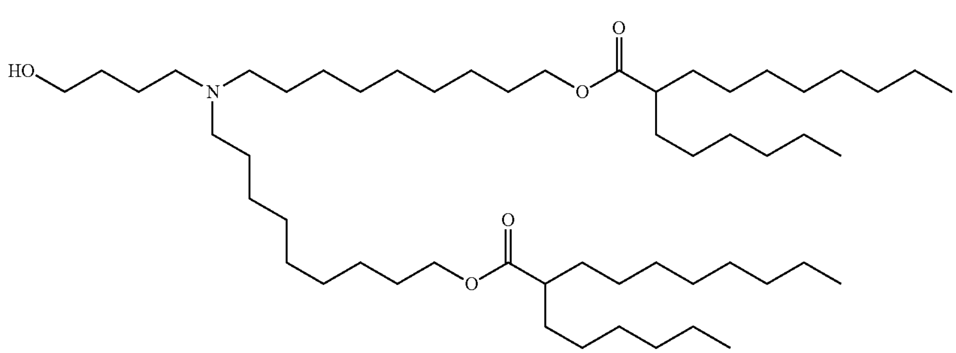 [SMILES: CCCCCCCCC(CCCCCC)C(=O)OCCCCCCCCCN(CCCCO)CCCCCCCCCOC(=O)C(CCCCCC)CCCCCCCC] |

TABLE 10b-continued
| Ionizable lipid number | Structure |
|---|---|
| 29 | 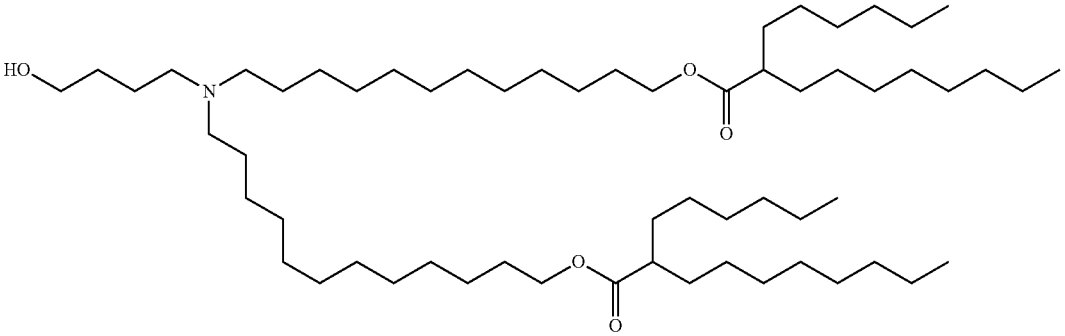 [SMILES: CCCCCCCCC(CCCCCC)C(=O)OCCCCCCCCCCCCN(CCCCO)CCCCCCCCCCCCOC(=O)C(CCCCCC)CCCCCCCC] |
| 30 | 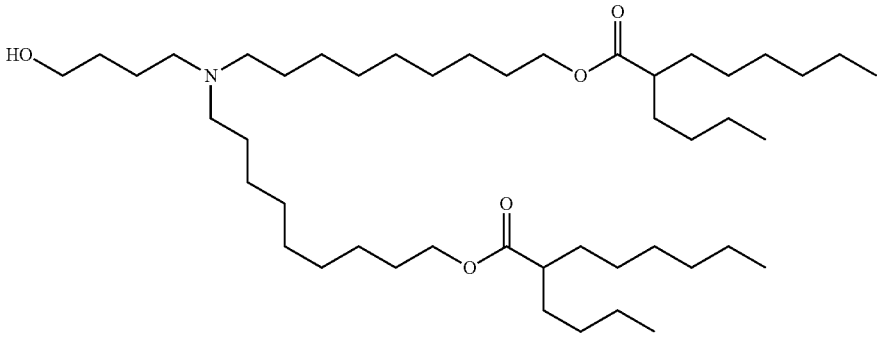 [SMILES: CCCCCCC(CCCC)C(=O)OCCCCCCCCCN(CCCCO)CCCCCCCCCOC(=O)C(CCCC)CCCCCC] |
| 31 | 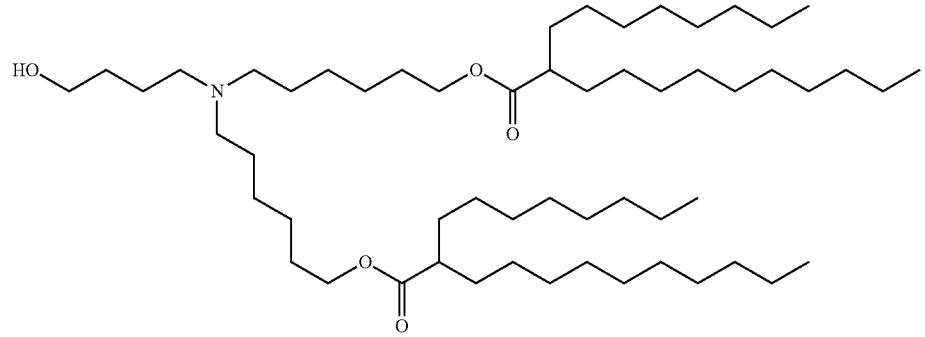 [SMILES: CCCCCCCCCCC(CCCCCCCC)C(=O)OCCCCCCN(CCCCO)CCCCCCOC(=O)C(CCCCCCCC)CCCCCCCCCC] |
| 32 | 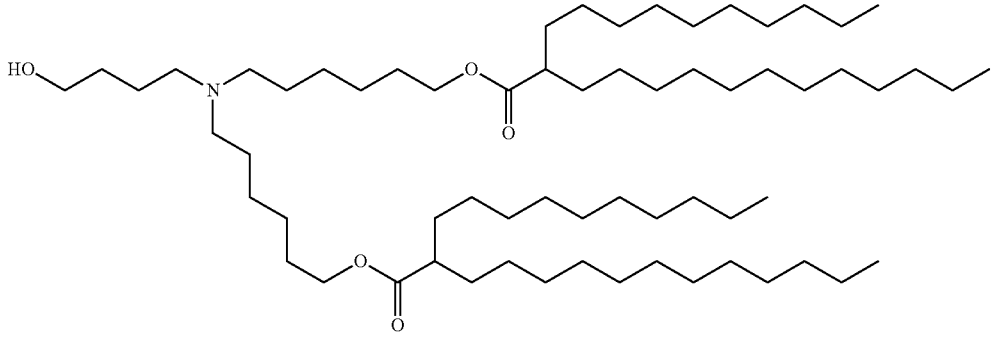 [SMILES: CCCCCCCCCCCCC(CCCCCCCCCC)C(=O)OCCCCCCN(CCCCO)CCCCCCOC(=O)C(CCCCCCCCCC)CCCCCCCCCCCC] |

TABLE 10b-continued
| Ionizable lipid number | Structure |
|---|---|
| 33 | 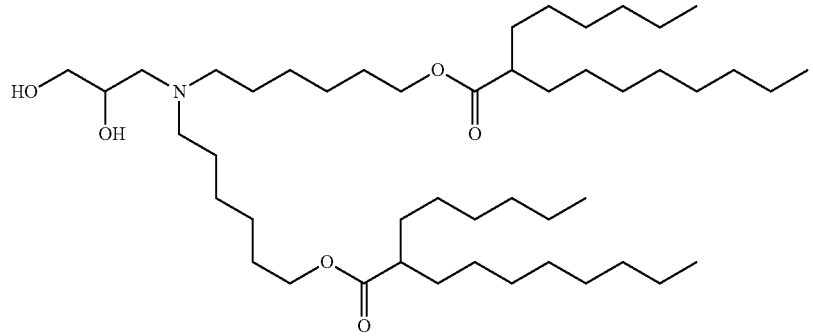 [SMILES: CCCCCCCCC(CCCCCC)C(=O)OCCCCCCN(CCCCCCOC(=O)C(CCCCCC)CCCCCCCC)CC(O)CO] |
| 34 | 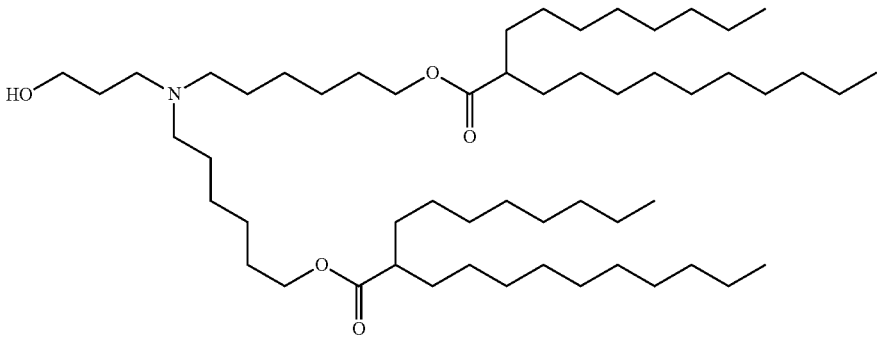 [SMILES: CCCCCCCCCCC(CCCCCCCC)C(=O)OCCCCCCN(CCCO)CCCCCCOC(=O)C(CCCCCCCC)CCCCCCCCCC] |
| 35 | 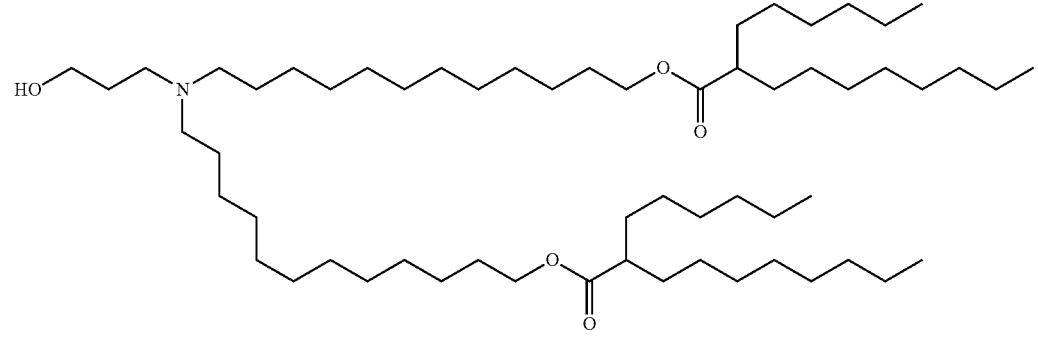 [SMILES: CCCCCCCCC(CCCCCC)C(=O)OCCCCCCCCCCCCN(CCCO)CCCCCCCCCCCCOC(=O)C(CCCCCC)CCCCCCCC] |
| 36 | 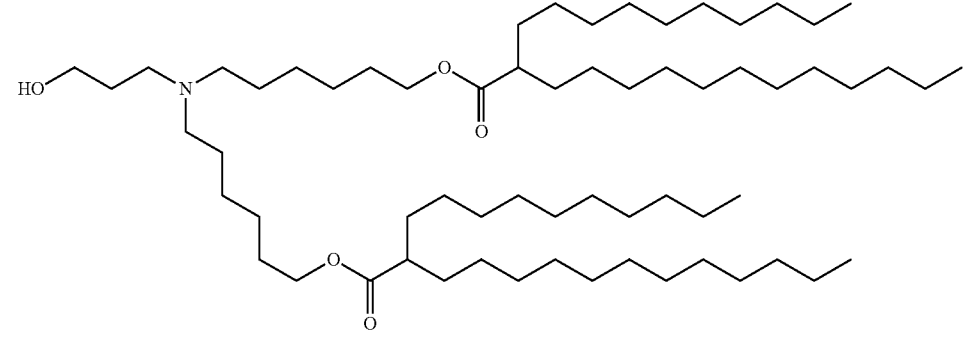 [SMILES: CCCCCCCCCCCCC(CCCCCCCCCC)C(=O)OCCCCCCN(CCCO)CCCCCCOC(=O)C(CCCCCCCCCC)CCCCCCCCCCCC] |

TABLE 10b-continued

| Ionizable lipid number | Structure |
|---|---|
| 37 | (structure) |
| 38 | (structure) |
| 39 | |

In some embodiments, an ionizable lipid has one of the structures set forth in Table 10 below.

TABLE 10

| Number | Structure |
|---|---|
| 1 | (structure) |
| 2 | (structure) |

TABLE 10-continued

| Number | Structure |
|---|---|
| 3 | (chemical structure) |
| 4 | (chemical structure) |
| 5 | (chemical structure) |
| 6 | (chemical structure) |

TABLE 10-continued

| Number | Structure |
|---|---|
| 7 | 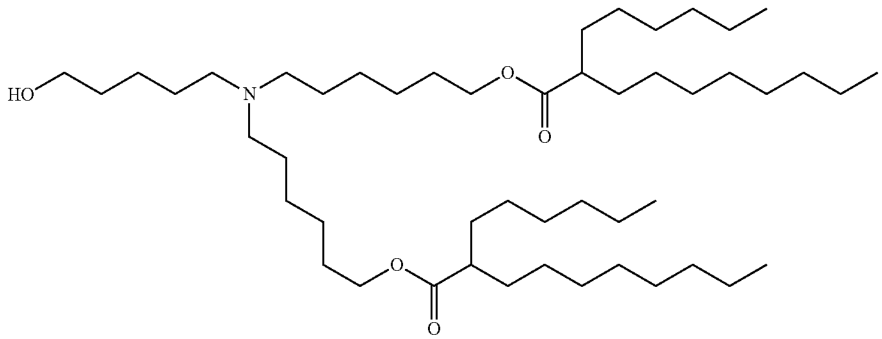 [SMILES: CCCCCCCCC(CCCCCC)C(=O)OCCCCCCN(CCCCCO)CCCCCCOC(=O)C(CCCCCC)CCCCCCCC] |
| 8 | 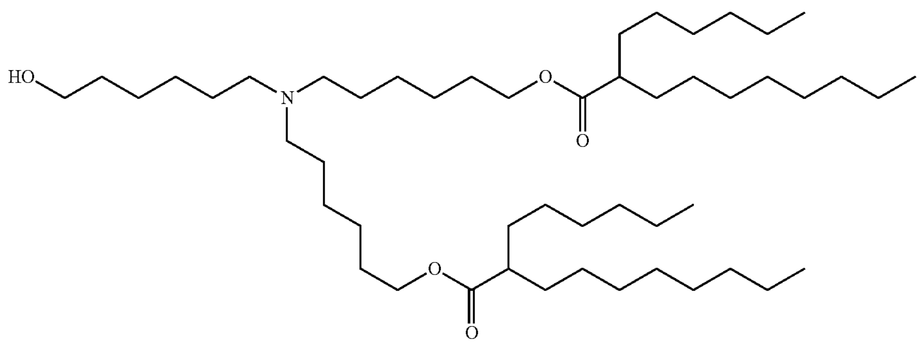 [SMILES: CCCCCCCCC(CCCCCC)C(=O)OCCCCCCN(CCCCCCO)CCCCCCOC(=O)C(CCCCCC)CCCCCCCC] |
| 9 | 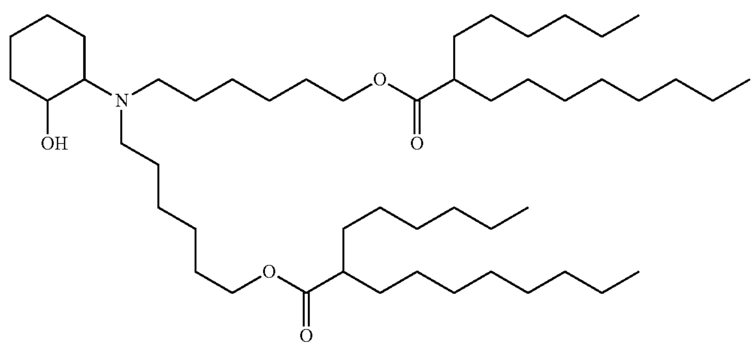 [SMILES: CCCCCCCCC(CCCCCC)C(=O)OCCCCCCN(CCCCCCOC(=O)C(CCCCCC)CCCCCCCC)C1CCCCC1O] |
| 10 | 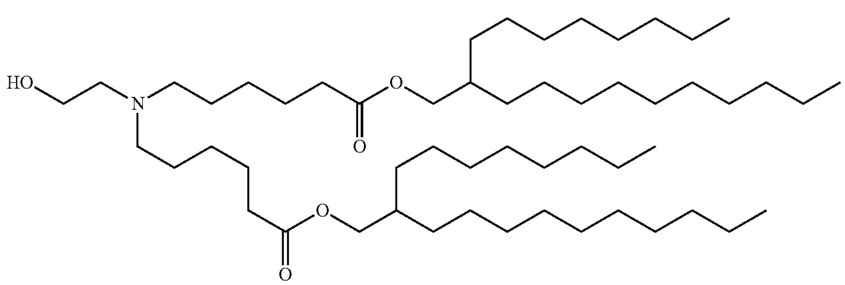 [SMILES: CCCCCCCCCCC(CCCCCCCC)COC(=O)CCCCCN(CCO)CCCCCC(=O)OCC(CCCCCCCC)CCCCCCCCCC] |
| 11 | 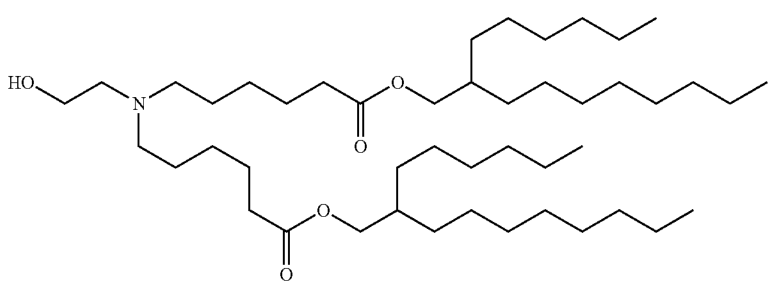 [SMILES: CCCCCCCCC(CCCCCC)COC(=O)CCCCCN(CCO)CCCCCC(=O)OCC(CCCCCC)CCCCCCCC] |

TABLE 10-continued
| Number | Structure |
|---|---|
| 12 | 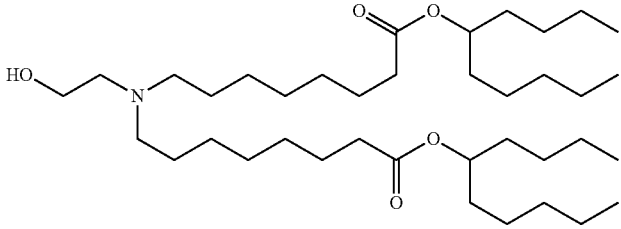 [SMILES: CCCCCC(CCCC)OC(=O)CCCCCCCN(CCO)CCCCCCCC(=O)OC(CCCC)CCCCC] |
| 13 | 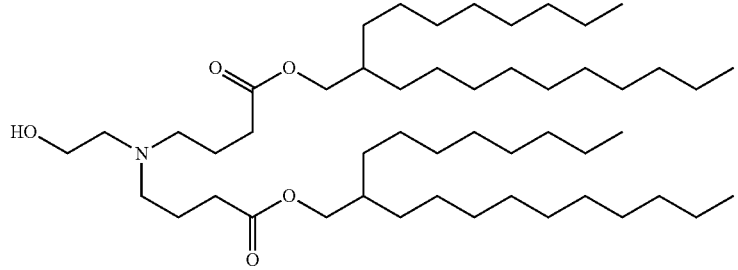 [SMILES: CCCCCCCCCCC(CCCCCCCC)COC(=O)CCCN(CCO)CCCC(=O)OCC(CCCCCCCC)CCCCCCCCCC] |
| 14 | 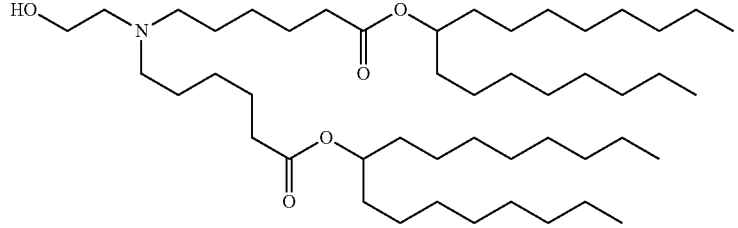 [SMILES: CCCCCCCCC(CCCCCCCC)OC(=O)CCCCCN(CCO)CCCCCC(=O)OC(CCCCCCCC)CCCCCCCC] |
| 15 | 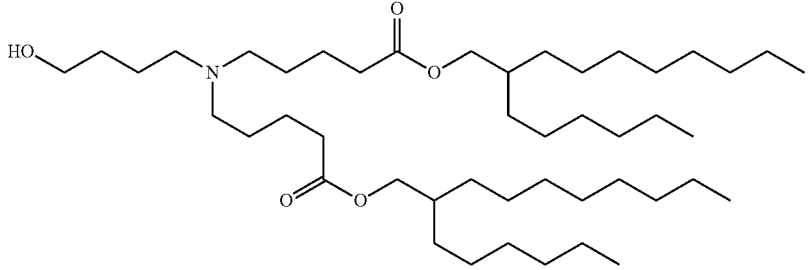 [SMILES: CCCCCCCCC(CCCCCC)COC(=O)CCCCN(CCCCO)CCCCC(=O)OCC(CCCCCC)CCCCCCCC] |
| 16 | 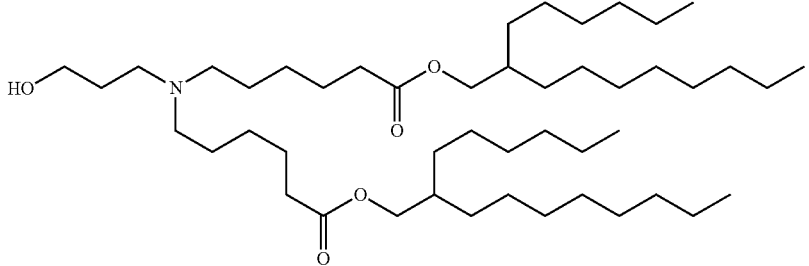 [SMILES: CCCCCCCCC(CCCCCC)COC(=O)CCCCCN(CCCO)CCCCCC(=O)OCC(CCCCCC)CCCCCCCC] |
| 17 | 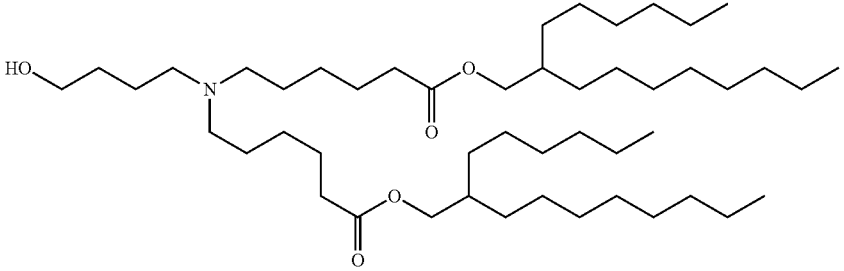 [SMILES: CCCCCCCCC(CCCCCC)COC(=O)CCCCCN(CCCCO)CCCCCC(=O)OCC(CCCCCC)CCCCCCCC] |

TABLE 10-continued
| Number | Structure |
|---|---|
| 18 | 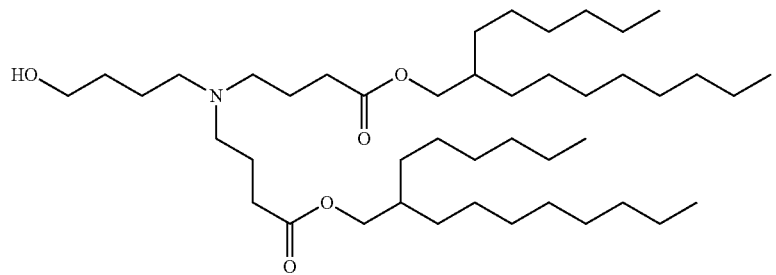 [SMILES: CCCCCCCCC(CCCCCC)COC(=O)CCCN(CCCCO)CCCC(=O)OCC(CCCCCC)CCCCCCCC] |
| 19 | 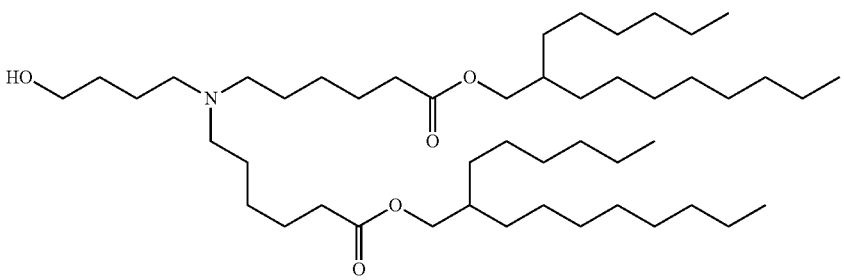 [SMILES: CCCCCCCCC(CCCCCC)COC(=O)CCCCCN(CCCCO)CCCCCC(=O)OCC(CCCCCC)CCCCCCCC] |
| 20 | 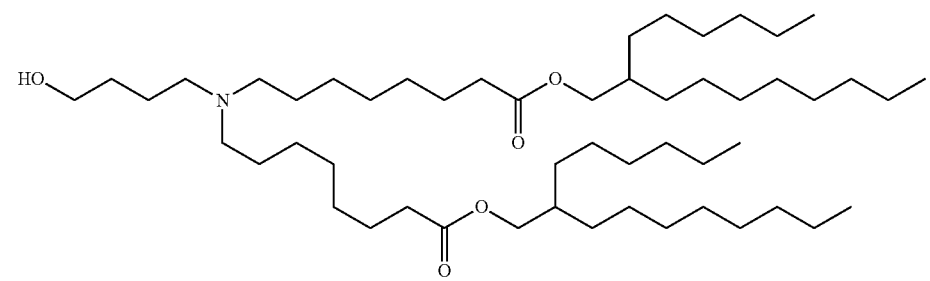 [SMILES: CCCCCCCCC(CCCCCC)COC(=O)CCCCCCCN(CCCCO)CCCCCCCC(=O)OCC(CCCCCC)CCCCCCCC] |
| 21 | 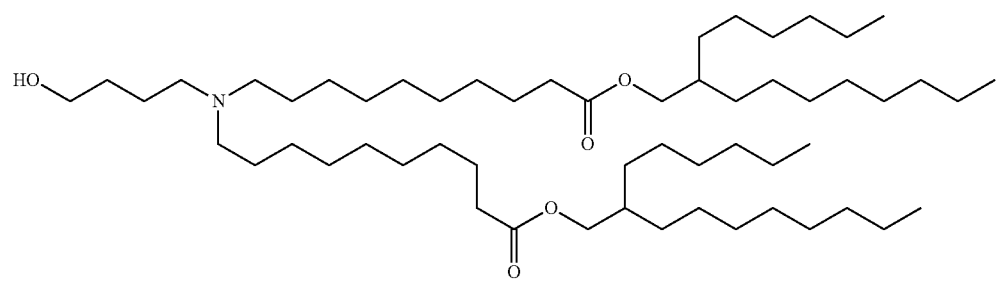 [SMILES: CCCCCCCCC(CCCCCC)COC(=O)CCCCCCCCCN(CCCCO)CCCCCCCCCC(=O)OCC(CCCCCC)CCCCCCCC] |
| 22 | 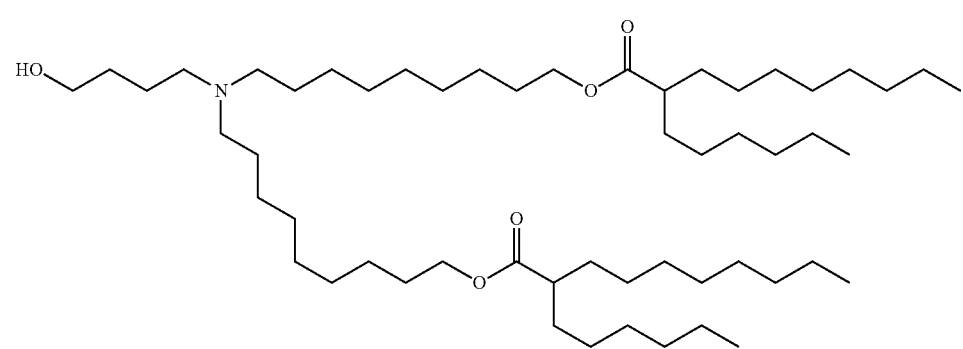 [SMILES: CCCCCCCCC(CCCCCC)C(=O)OCCCCCCCCCN(CCCCO)CCCCCCCCCOC(=O)C(CCCCCC)CCCCCCCC] |

TABLE 10-continued

| Number | Structure |
|---|---|
| 23 | 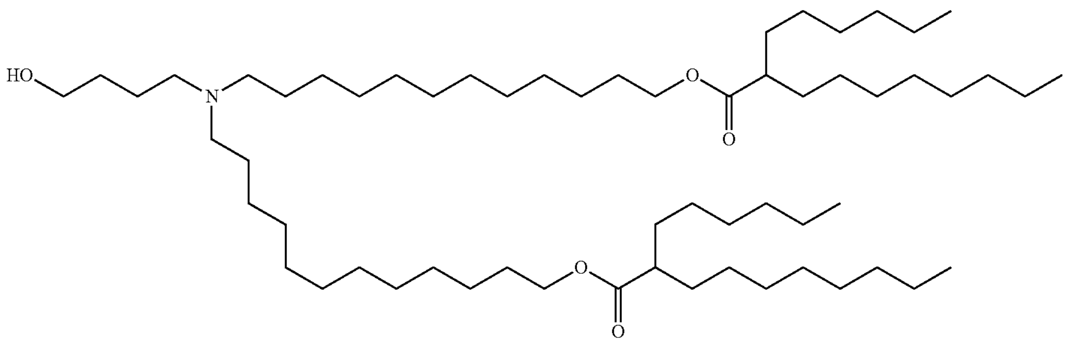 [SMILES: CCCCCCCCC(CCCCCC)C(=O)OCCCCCCCCCCCCN(CCCCO)CCCCCCCCCCCCOC(=O)C(CCCCCC)CCCCCCCC] |
| 24 | 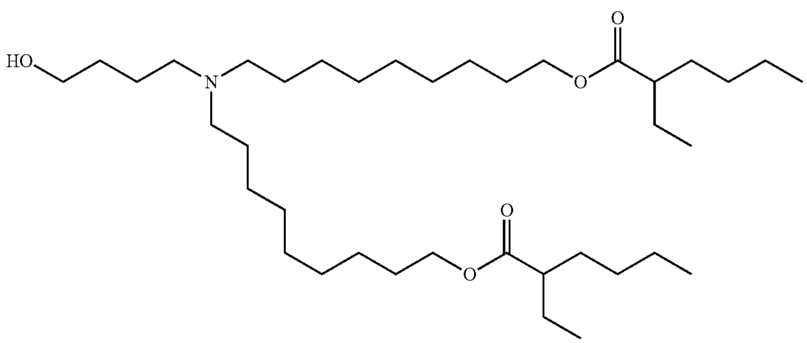 [SMILES: CCCCC(CC)C(=O)OCCCCCCCCCN(CCCCO)CCCCCCCCCOC(=O)C(CC)CCCC] |
| 25 | 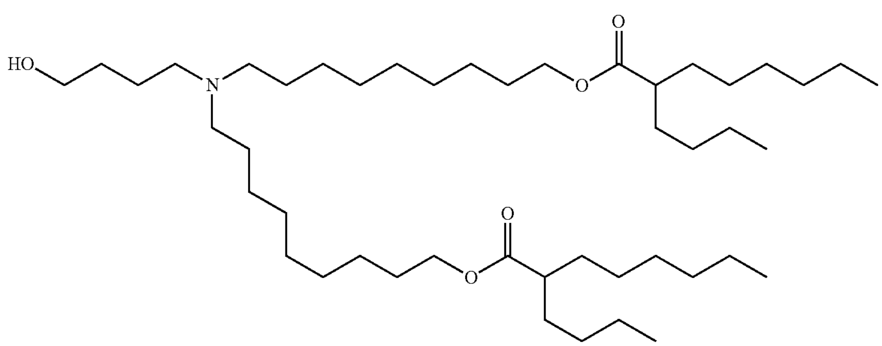 [SMILES: CCCCCCC(CCCC)C(=O)OCCCCCCCCCN(CCCCO)CCCCCCCCCOC(=O)C(CCCC)CCCCCC] |
| 26 | 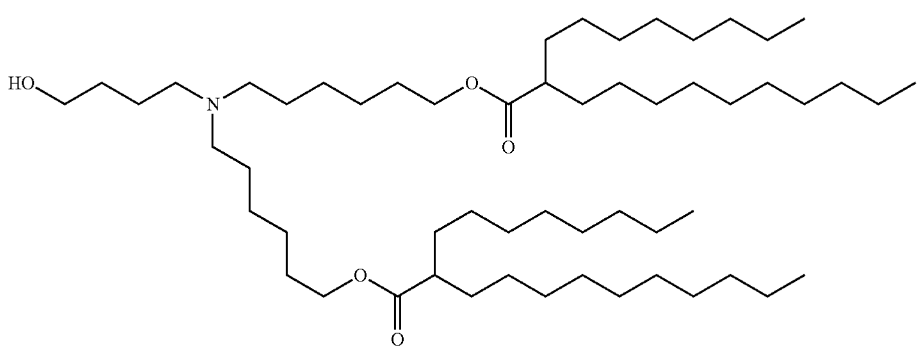 [SMILES: CCCCCCCCCCC(CCCCCCCC)C(=O)OCCCCCCN(CCCCO)CCCCCCOC(=O)C(CCCCCCCC)CCCCCCCCCC] |

TABLE 10-continued
| Number | Structure |
|---|---|
| 27 | 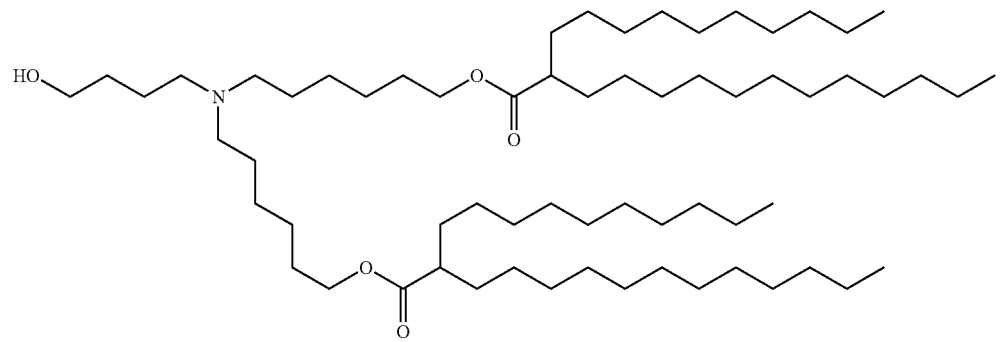 [SMILES: CCCCCCCCCCCCC(CCCCCCCCCC)C(=O)OCCCCCCN(CCCCO)CCCCCCOC(=O)C(CCCCCCCCCC)CCCCCCCCCCCC] |
| 28 | 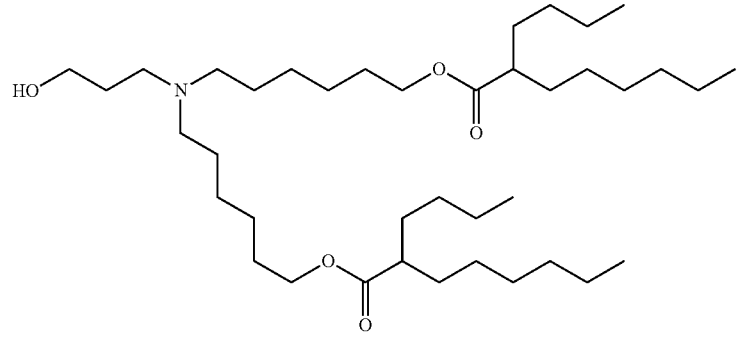 [SMILES: CCCCCCC(CCCC)C(=O)OCCCCCCN(CCCO)CCCCCCOC(=O)C(CCCC)CCCCCC] |
| 29 | 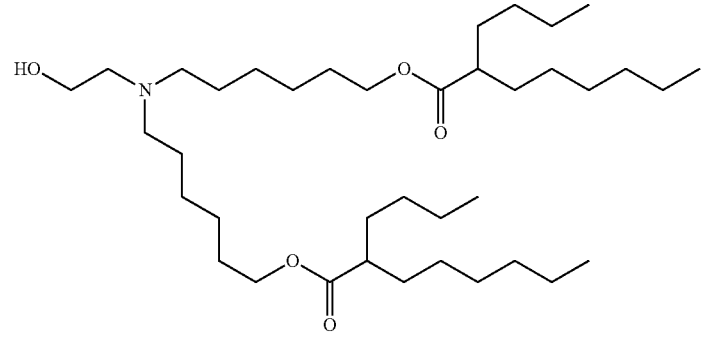 [SMILES: CCCCCCC(CCCC)C(=O)OCCCCCCN(CCO)CCCCCCOC(=O)C(CCCC)CCCCCC] |
| 30 | 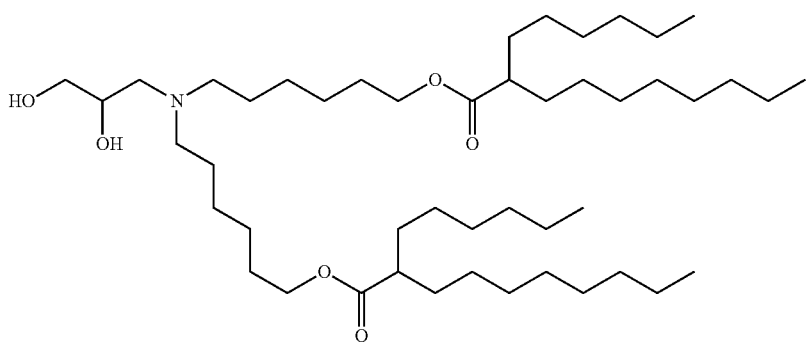 [SMILES: CCCCCCCCC(CCCCCC)C(=O)OCCCCCCN(CCCCCCOC(=O)C(CCCCCC)CCCCCCCC)CC(O)CO] |

TABLE 10-continued

| Number | Structure |
| --- | --- |
| 31 | 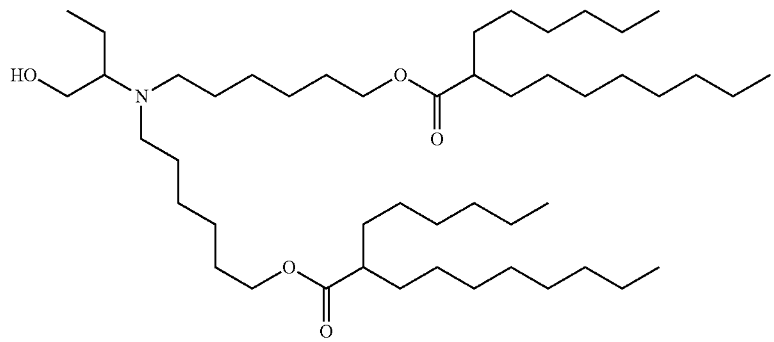 [SMILES: CCCCCCCCC(CCCCCC)C(=O)OCCCCCCN(CCCCCCOC(=O)C(CCCCCC)CCCCCCCC)C(CC)CO] |
| 32 | 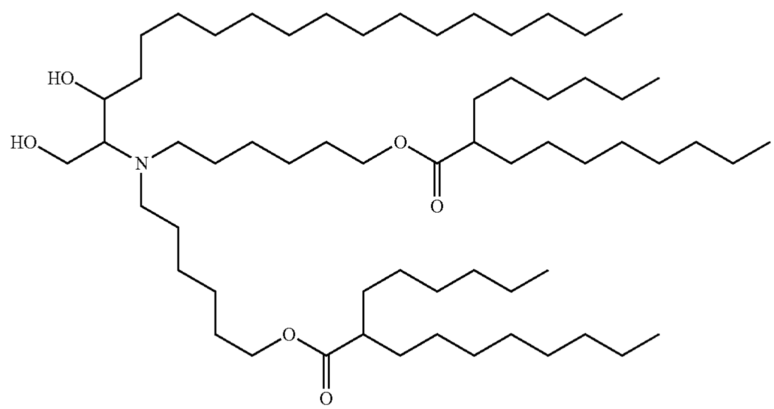 [SMILES: CCCCCCCCCCCCCCCC(O)C(CO)N(CCCCCCOC(=O)C(CCCCCC)CCCCCCCC)CCCCCCOC(=O)C(CCCCCC)CCCCCCCC] |
| 33 | 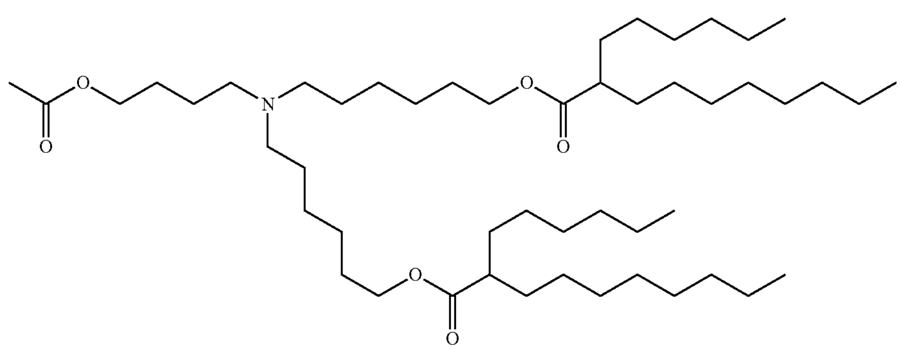 [SMILES: CCCCCCCCC(CCCCCC)C(=O)OCCCCCCN(CCCCCCOC(=O)C(CCCCCC)CCCCCCCC)CCCCOC(C)=O] |
| 34 | 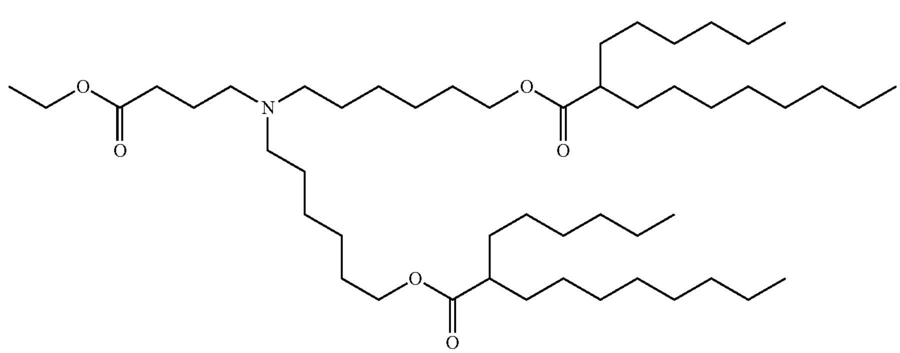 [SMILES: CCCCCCCCC(CCCCCC)C(=O)OCCCCCCN(CCCCCCOC(=O)C(CCCCCC)CCCCCCCC)CCCC(=O)OCC] |

TABLE 10-continued
| Number | Structure |
|---|---|
| 35 | 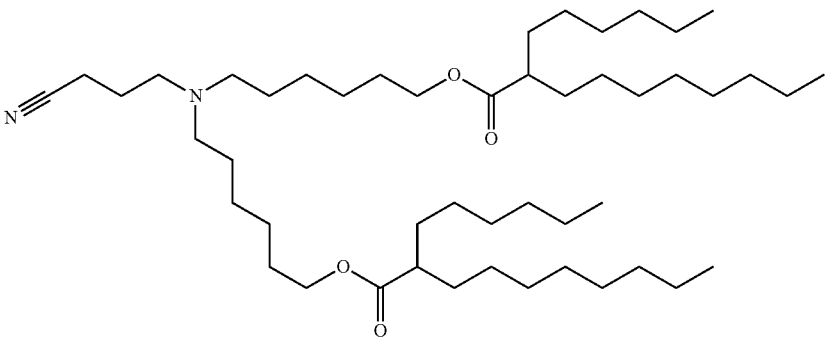 [SMILES: CCCCCCCCC(CCCCCC)C(=O)OCCCCCCN(CCCC#N)CCCCCCOC(=O)C(CCCCCC)CCCCCCCC] |
| 36 | 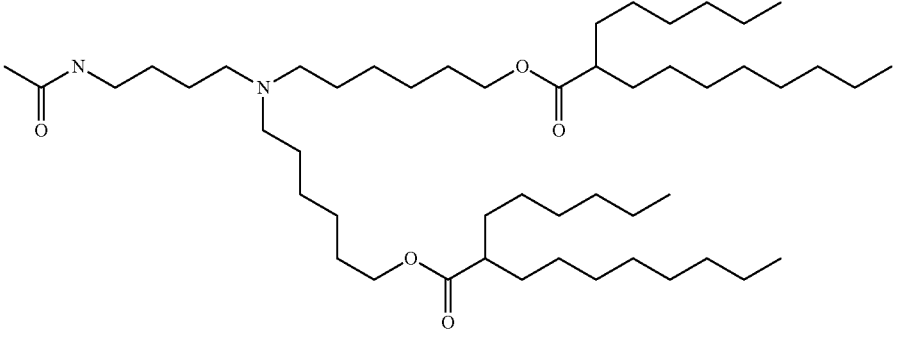 [SMILES: CCCCCCCCC(CCCCCC)C(=O)OCCCCCCN(CCCCCCOC(=O)C(CCCCCC)CCCCCCCC)CCCCNC(C)=O] |
| 37 | 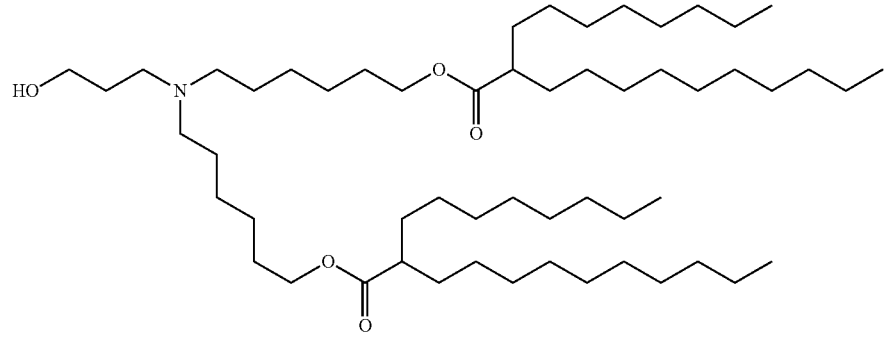 [SMILES: CCCCCCCCCCC(CCCCCCCC)C(=O)OCCCCCCN(CCCO)CCCCCCOC(=O)C(CCCCCCCC)CCCCCCCCCC] |
| 38 | 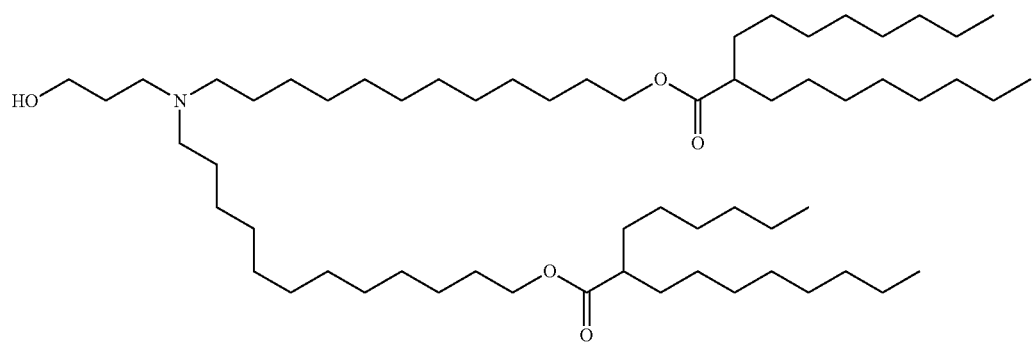 [SMILES: CCCCCCCCC(CCCCCC)C(=O)OCCCCCCCCCCCCN(CCCO)CCCCCCCCCCCCOC(=O)C(CCCCCCCC)CCCCCCCC] |

TABLE 10-continued

| Number | Structure |
|---|---|
| 39 | 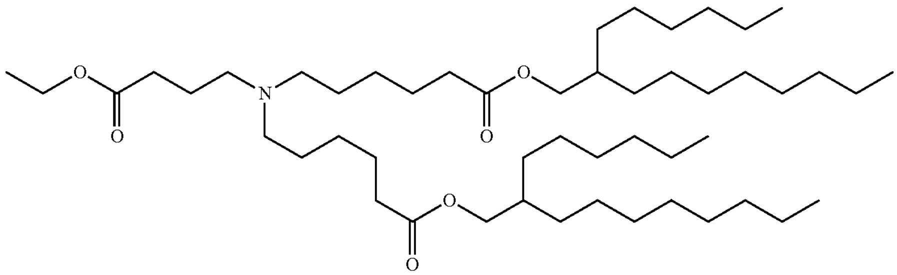 [SMILES: CCCCCCCCC(CCCCCC)COC(=O)CCCCCN(CCCCCC(=O)OCC(CCCCCC)CCCCCCCC)CCCC(=O)OCC] |
| 40 | 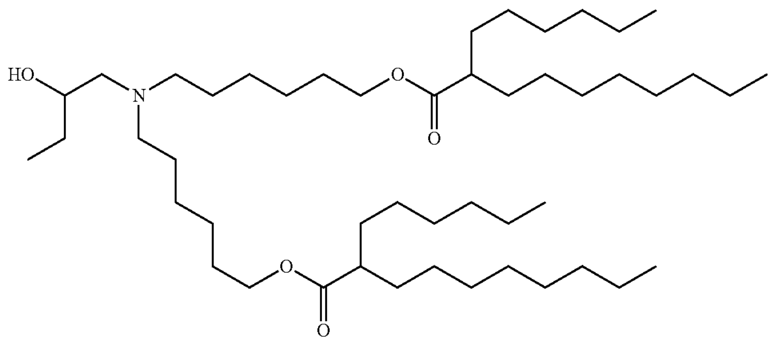 [SMILES: CCCCCCCCC(CCCCCC)C(=O)OCCCCCCN(CCCCCCOC(=O)C(CCCCCC)CCCCCCCC)CC(O)CC] |
| 41 | 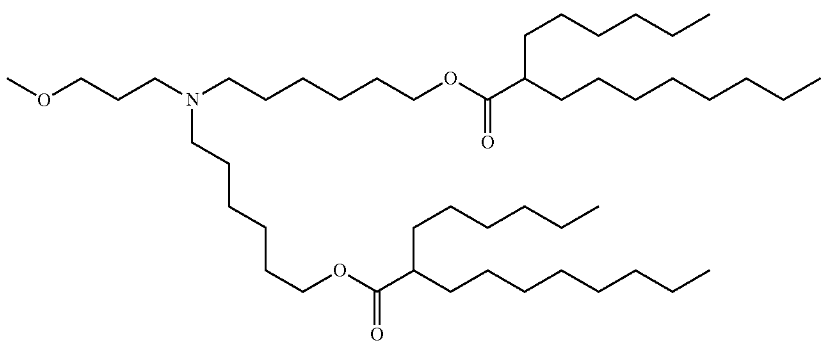 [SMILES: CCCCCCCCC(CCCCCC)C(=O)OCCCCCCN(CCCCCCOC(=O)C(CCCCCC)CCCCCCCC)CCCOC] |
| 42 | 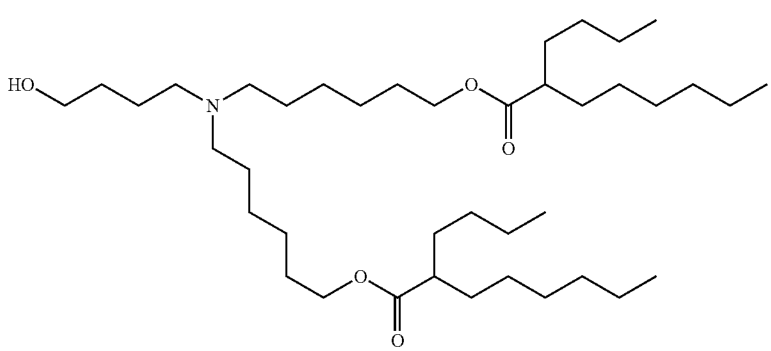 [SMILES: CCCCCCC(CCCC)C(=O)OCCCCCCN(CCCCO)CCCCCCOC(=O)C(CCCC)CCCCCC] |

TABLE 10-continued

| Number | Structure |
|---|---|
| 43 | 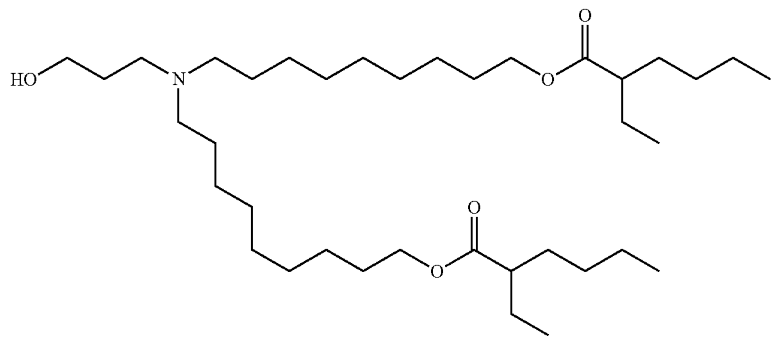 [SMILES: CCCCC(CC)C(=O)OCCCCCCCCCN(CCCO)CCCCCCCCCOC(=O)C(CC)CCCC] |
| 44 | 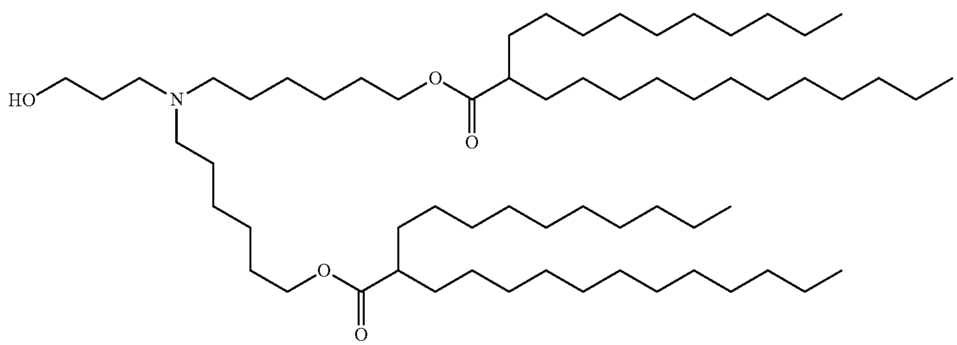 [SMILES: CCCCCCCCCCCCC(CCCCCCCCCC)C(=O)OCCCCCCN(CCCO)CCCCCCOC(=O)C(CCCCCCCCCC)CCCCCCCCCCCC] |
| 45 | 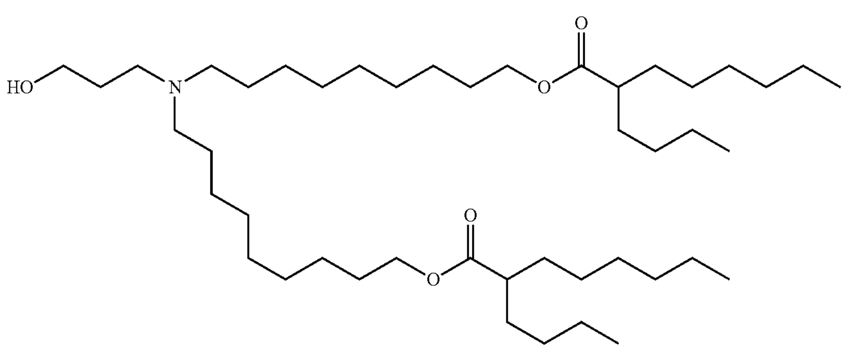 [SMILES: CCCCCCC(CCCC)C(=O)OCCCCCCCCCN(CCCO)CCCCCCCCCOC(=O)C(CCCC)CCCCCC] |
| 46 | 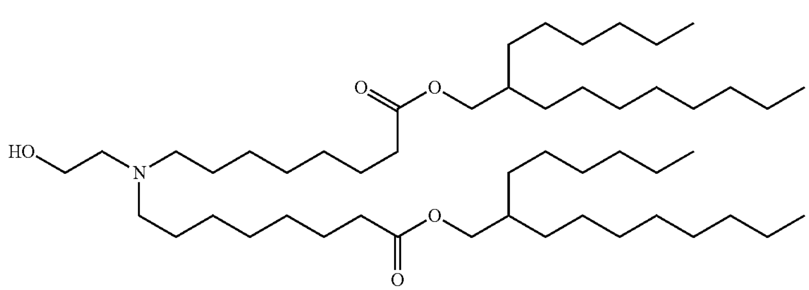 [SMILES: CCCCCCCCC(CCCCCC)COC(=O)CCCCCCCN(CCO)CCCCCCCC(=O)OCC(CCCCCC)CCCCCCCC] |

TABLE 10-continued
| Number | Structure |
|---|---|
| 47 | 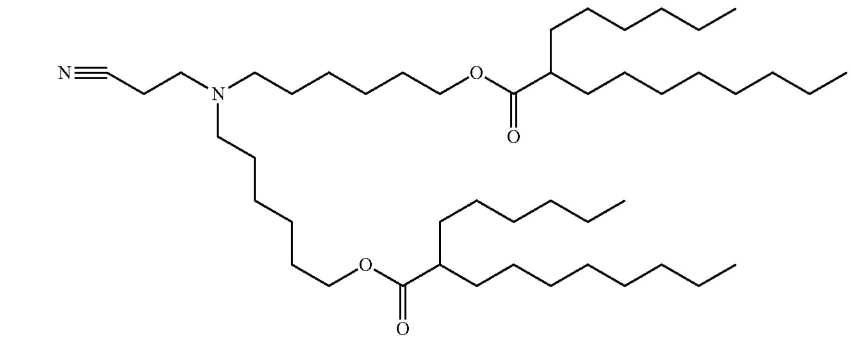 [SMILES: CCCCCCCCC(CCCCCC)C(=O)OCCCCCCN(CCC#N)CCCCCCOC(=O)C(CCCCCC)CCCCCCCC] |
| 48 | 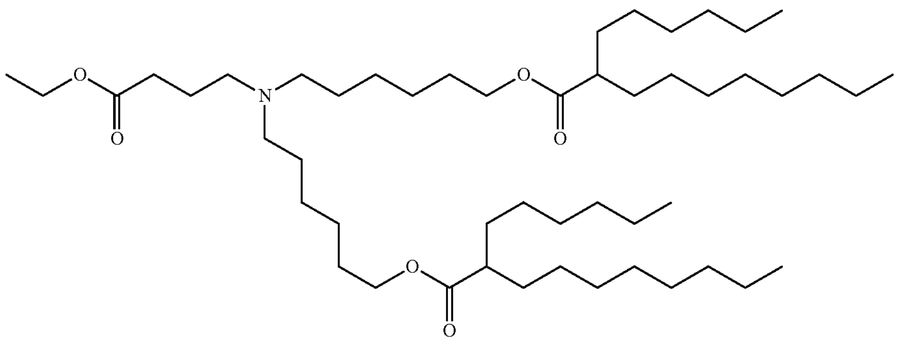 [SMILES: CCCCCCCCC(CCCCCC)C(=O)OCCCCCCN(CCCCCCOC(=O)C(CCCCCC)CCCCCCCC)CCCC(=O)OCC] |
| 49 | 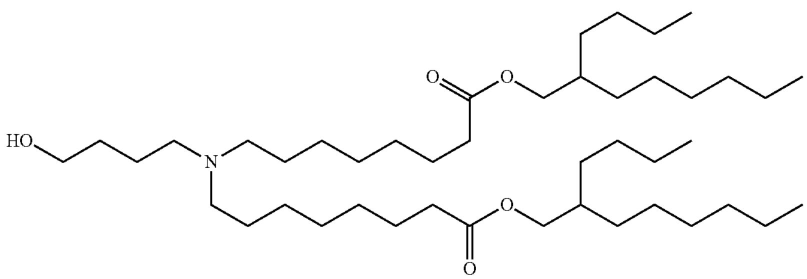 [SMILES: CCCCCCC(CCCC)COC(=O)CCCCCCCN(CCCCO)CCCCCCCC(=O)OCC(CCCC)CCCCCC] |
In some embodiments, the ionizable lipid has one of the structures set forth in Table 11 below. In some embodiments, the ionizable lipid as set forth in Table 11 is as described in international patent application PCT/US2010/061058.
TABLE 11
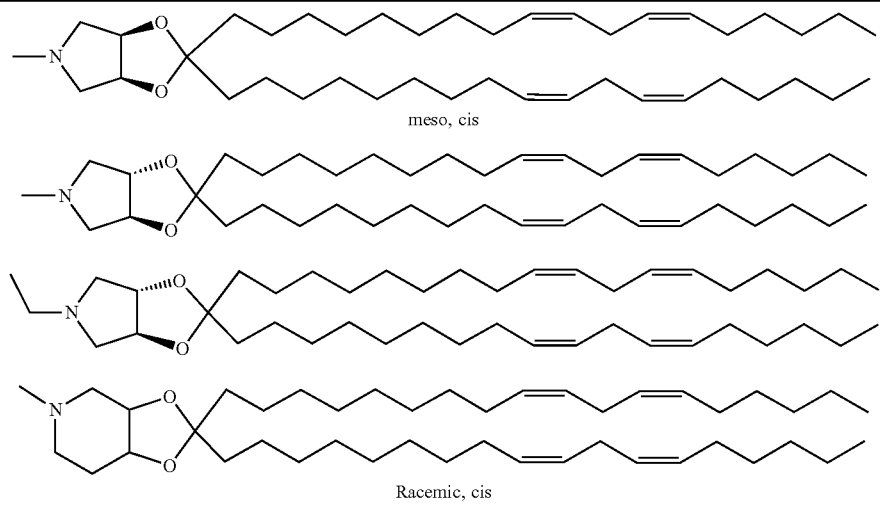
meso, cis
Racemic, cis TABLE 11-continued
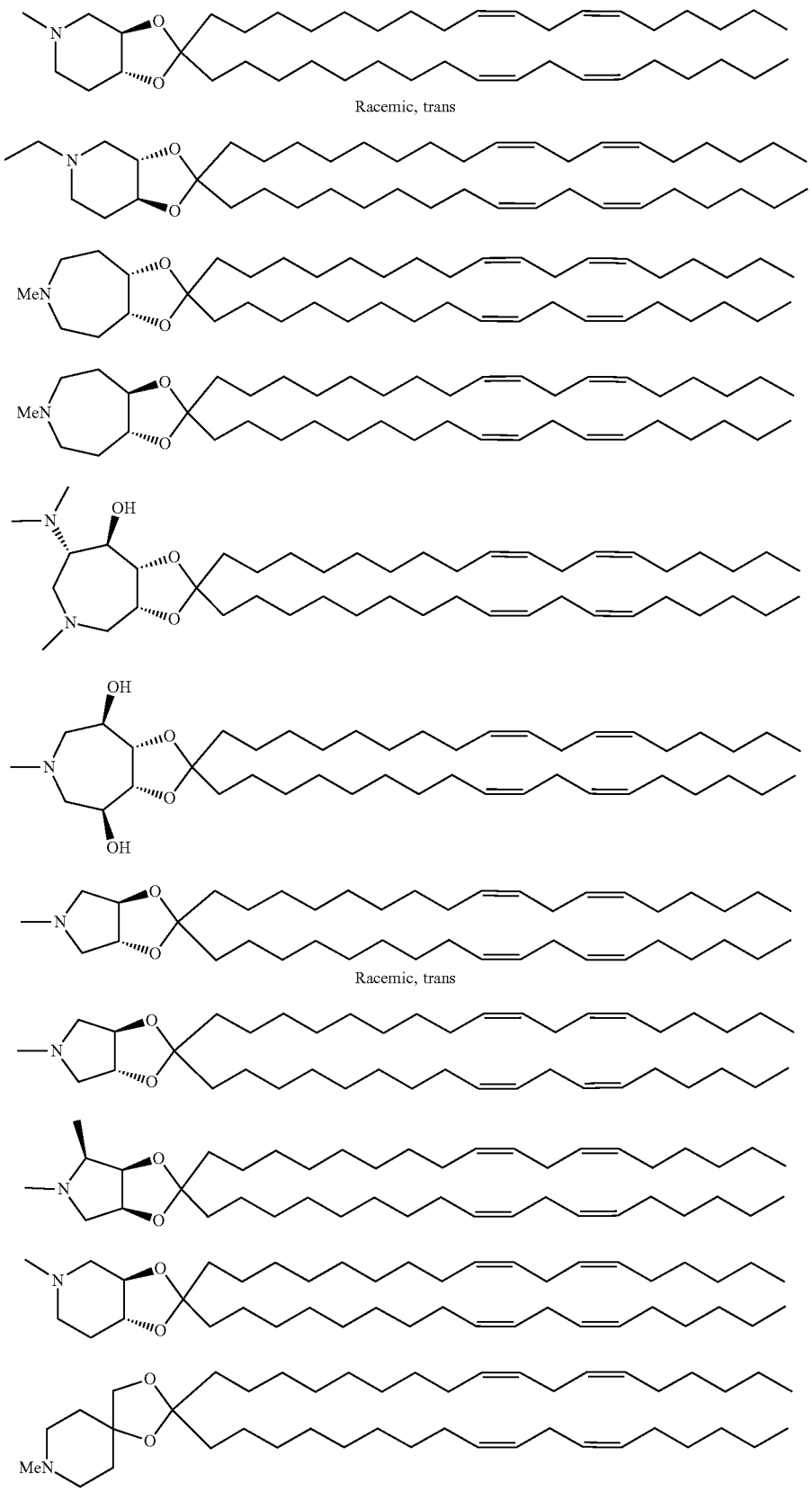

TABLE 11-continued
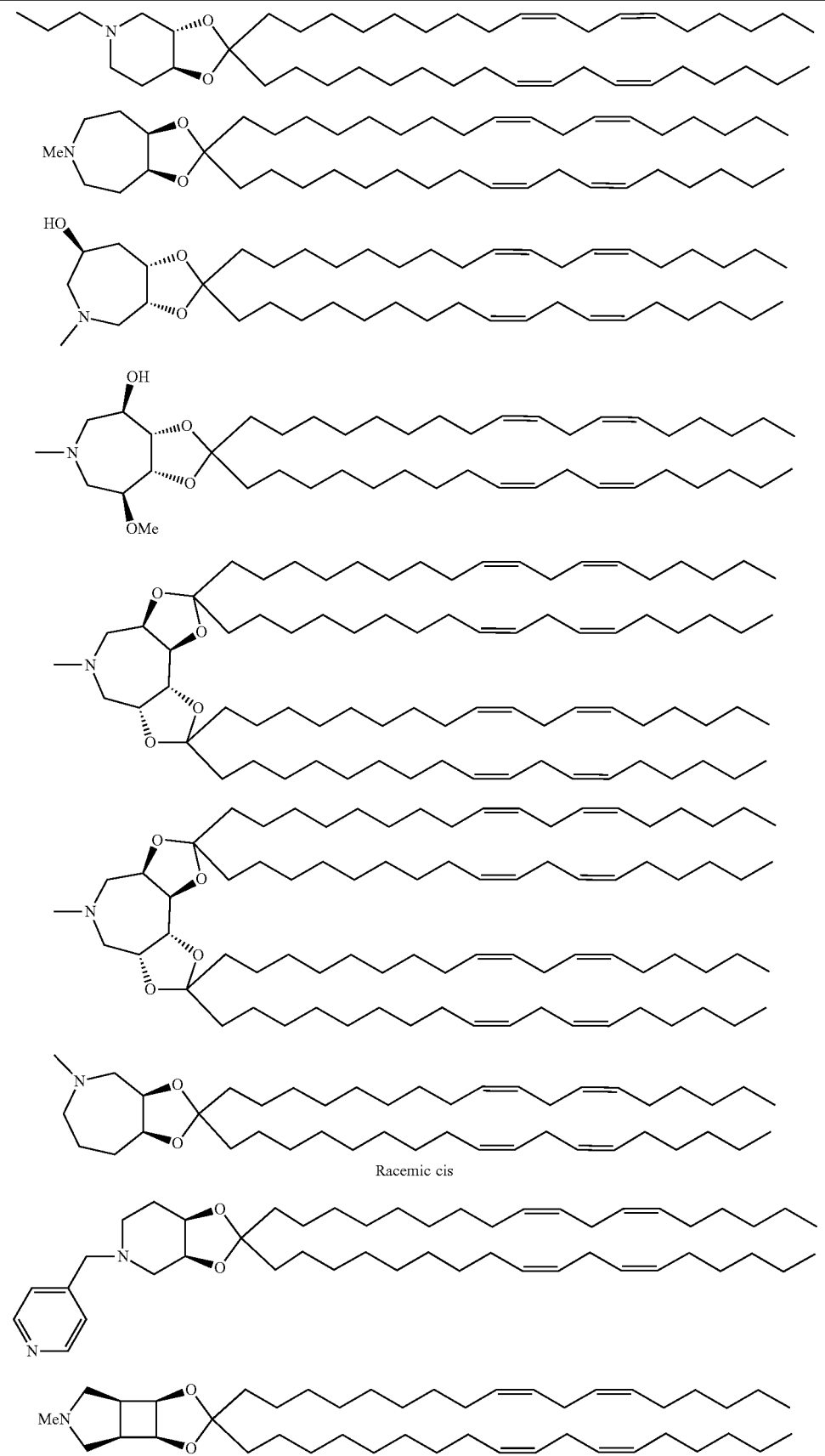
Racemic cis

TABLE 11-continued
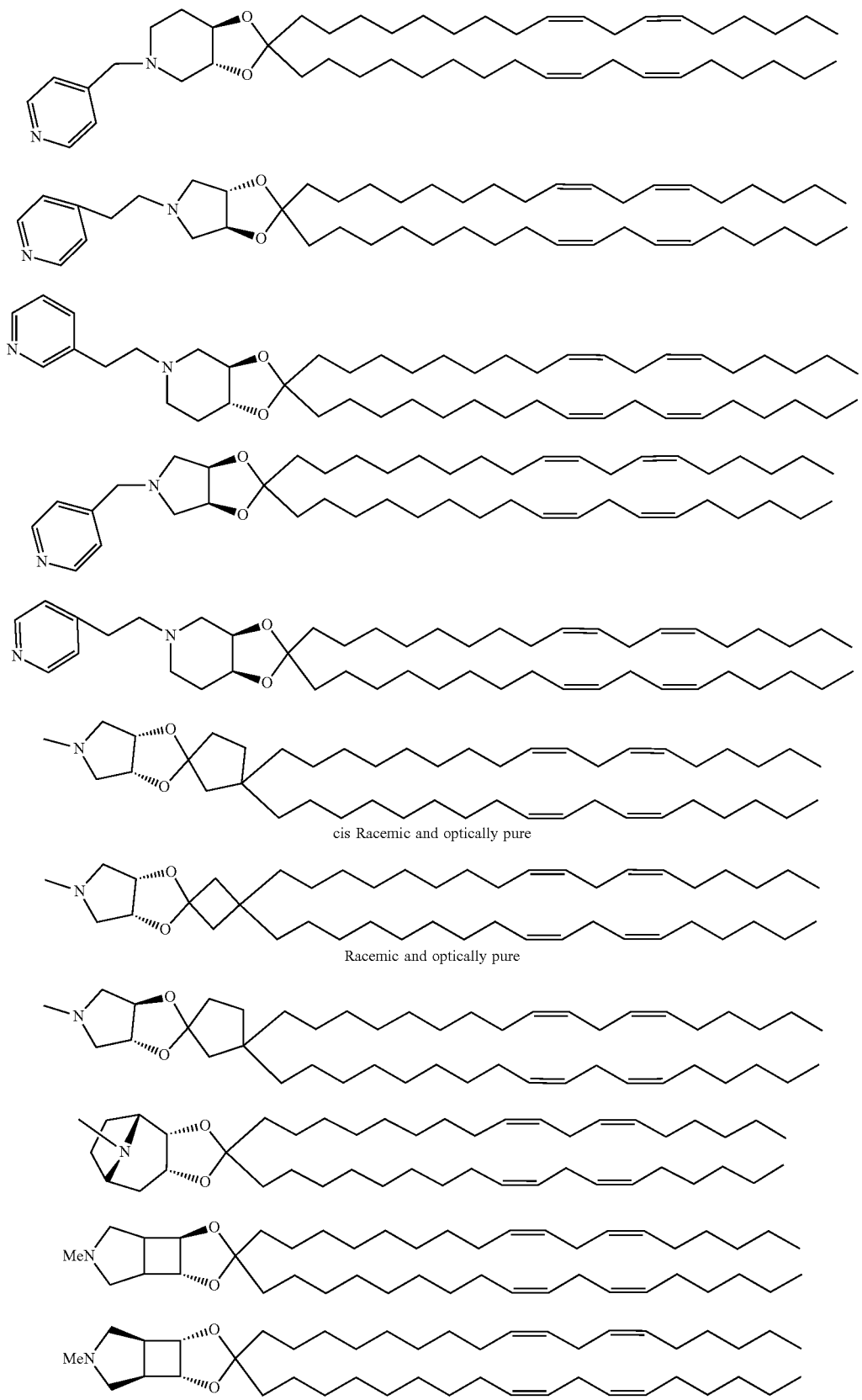
cis Racemic and optically pure
Racemic and optically pure TABLE 11-continued
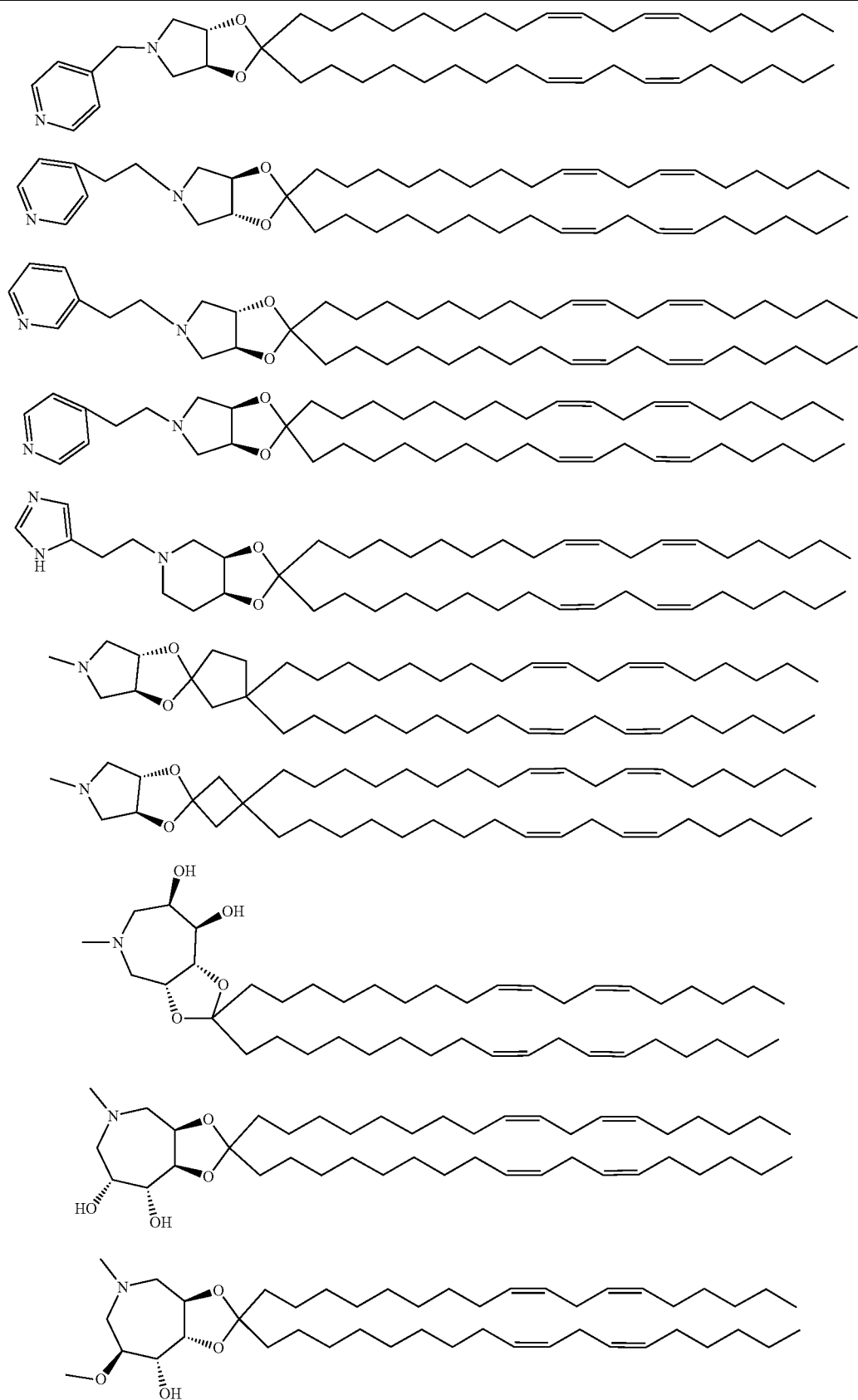

TABLE 11-continued
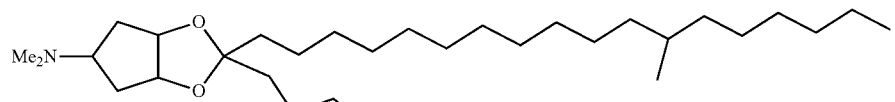
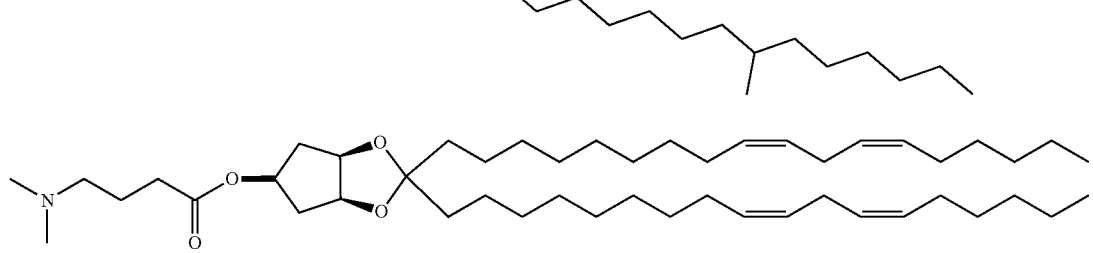
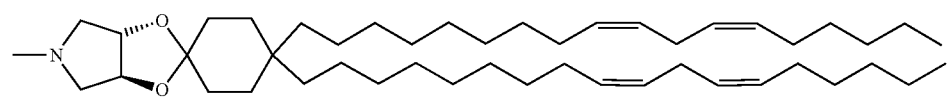
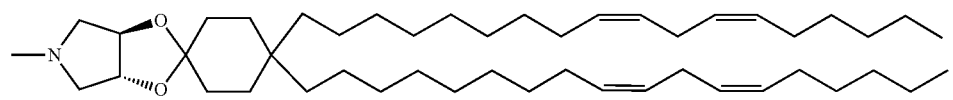 [SMILES: CCCCC/C=C\C/C=C\CCCCCCCCC1(CCCCCCCC/C=C\C/C=C\CCCCC)CCC2(CC1)O[C@@H]1CN(C)C[C@H]1O2]
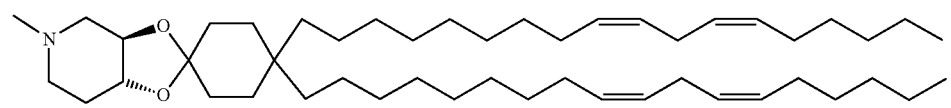
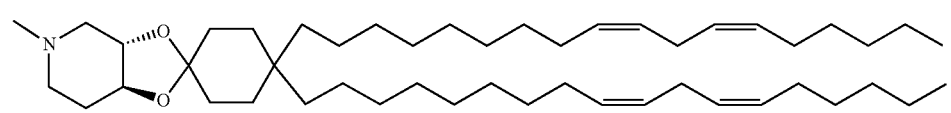 [SMILES: CCCCC/C=C\C/C=C\CCCCCCCCC1(CCCCCCCC/C=C\C/C=C\CCCCC)CCC2(CC1)O[C@H]1CCN(C)C[C@@H]1O2]
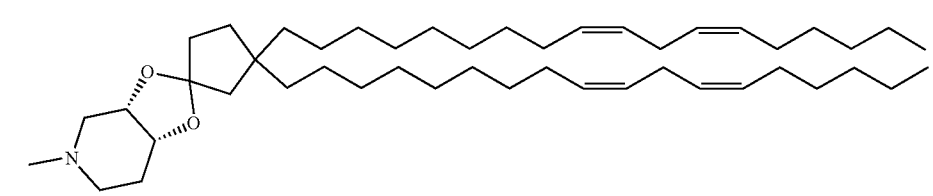
cis Racemic and optically pure
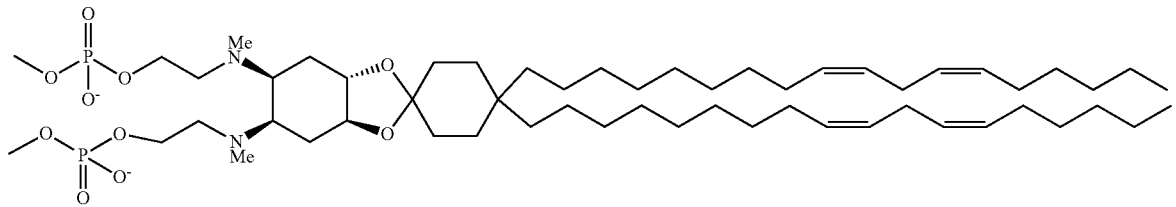 [SMILES: CCCCC/C=C\C/C=C\CCCCCCCCC1(CCCCCCCC/C=C\C/C=C\CCCCC)CCC2(CC1)O[C@H]1C[C@@H](N(C)CCOP(=O)([O-])OC)[C@@H](N(C)CCOP(=O)([O-])OC)C[C@@H]1O2]
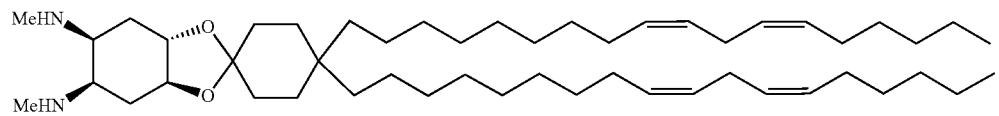 [SMILES: CCCCC/C=C\C/C=C\CCCCCCCCC1(CCCCCCCC/C=C\C/C=C\CCCCC)CCC2(CC1)O[C@H]1C[C@H](NC)[C@H](NC)C[C@@H]1O2]
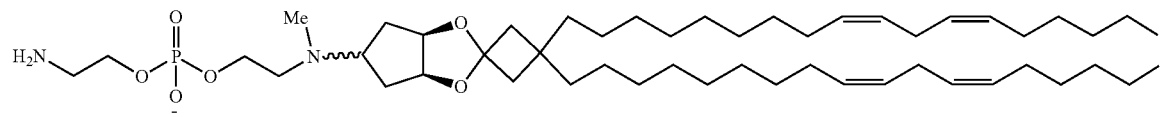 [SMILES: CCCCC/C=C\C/C=C\CCCCCCCCC1(CCCCCCCC/C=C\C/C=C\CCCCC)CC2(C1)O[C@H]1CC(N(C)CCOP(=O)(O)OCCN)C[C@H]1O2]

TABLE 11-continued
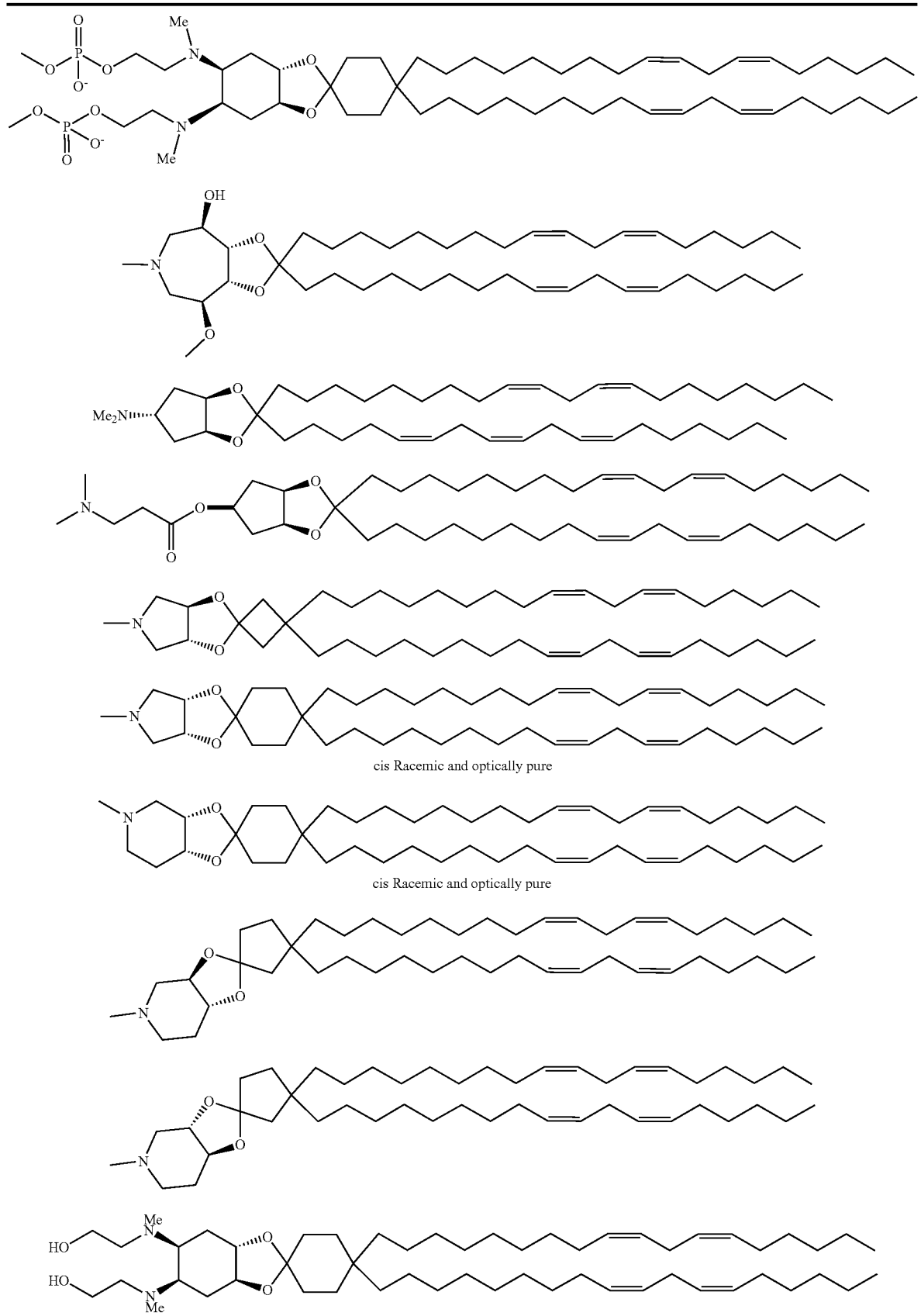
cis Racemic and optically pure
cis Racemic and optically pure TABLE 11-continued
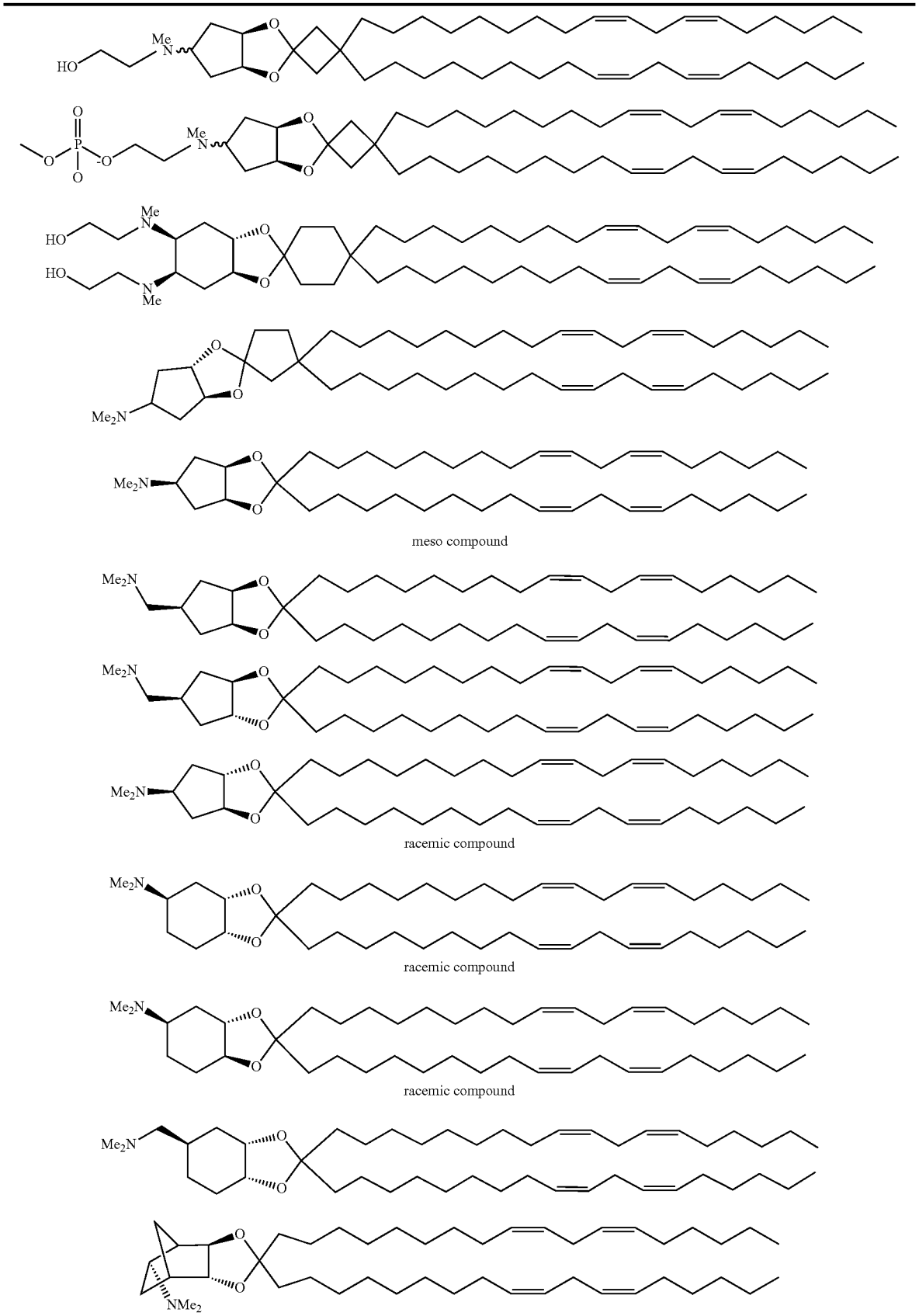

TABLE 11-continued
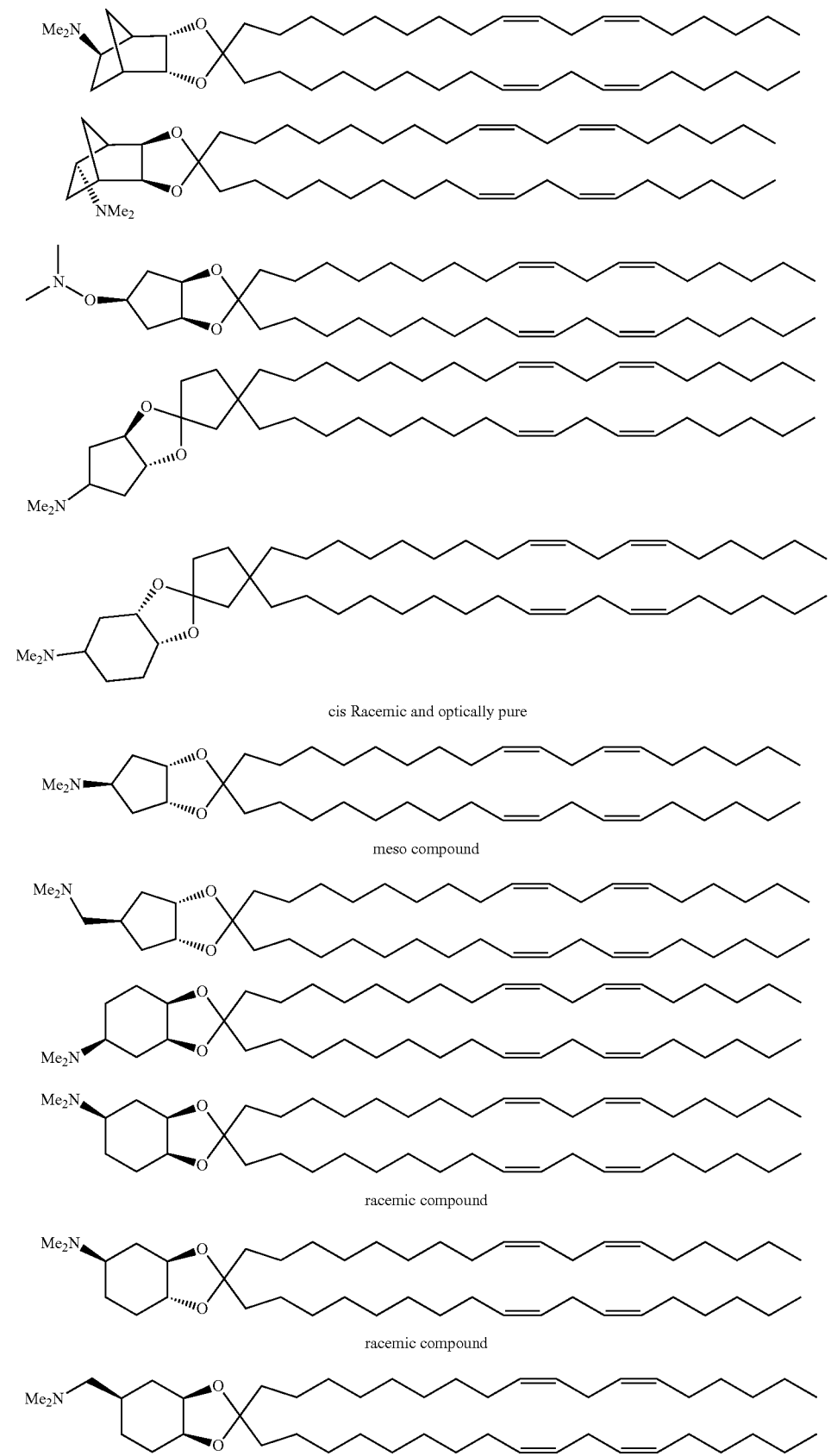
cis Racemic and optically pure
meso compound
racemic compound
racemic compound TABLE 11-continued
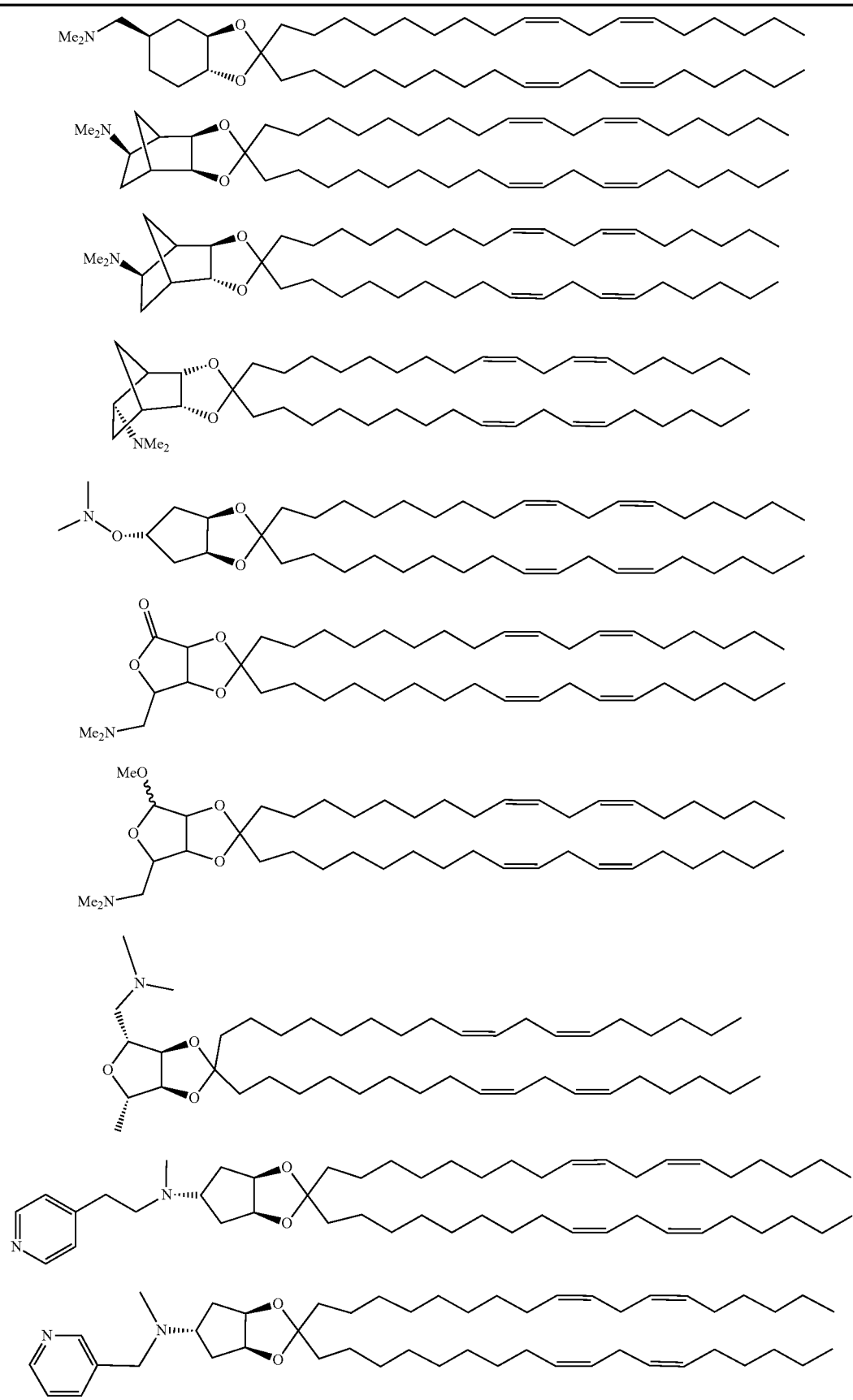

TABLE 11-continued
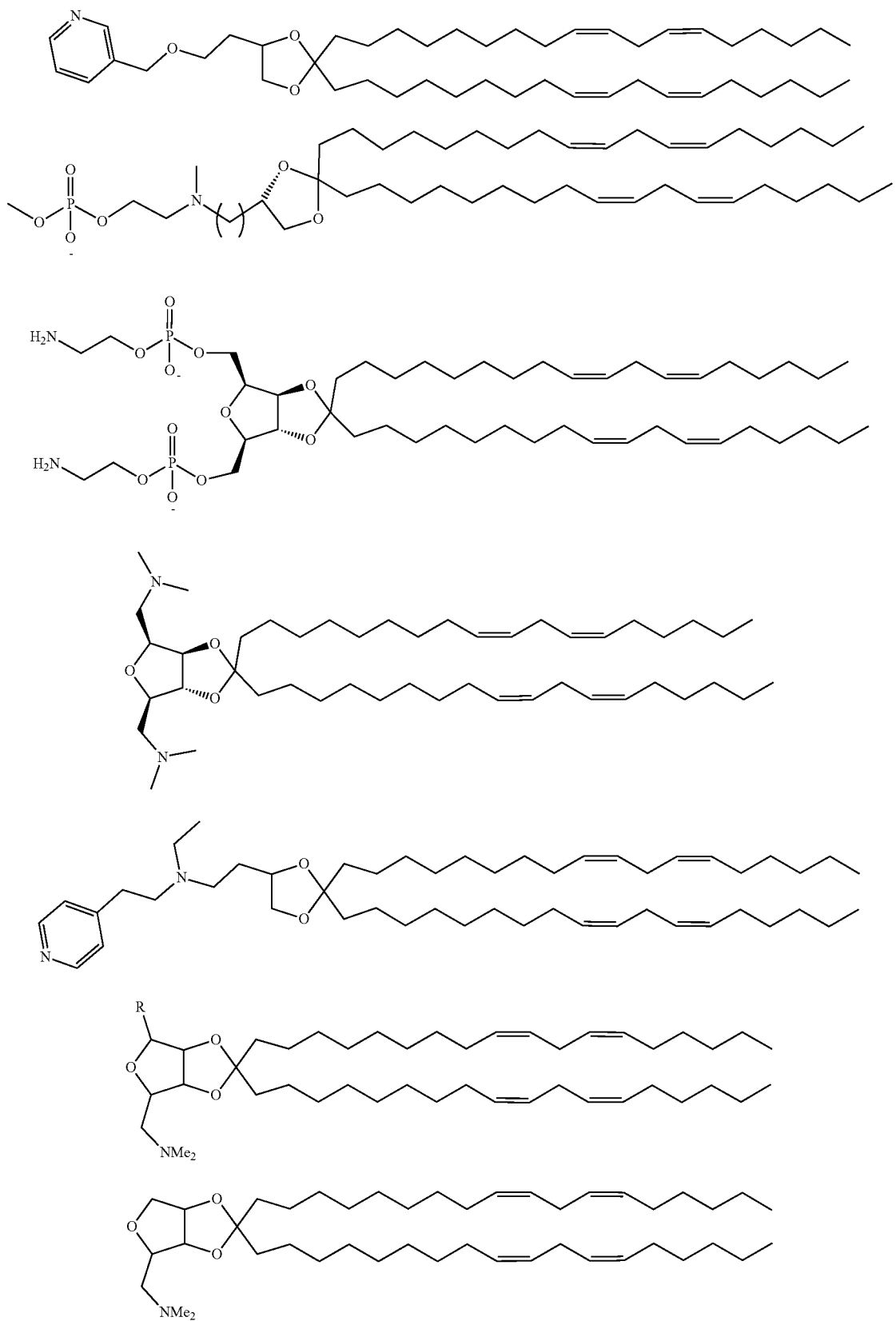

TABLE 11-continued
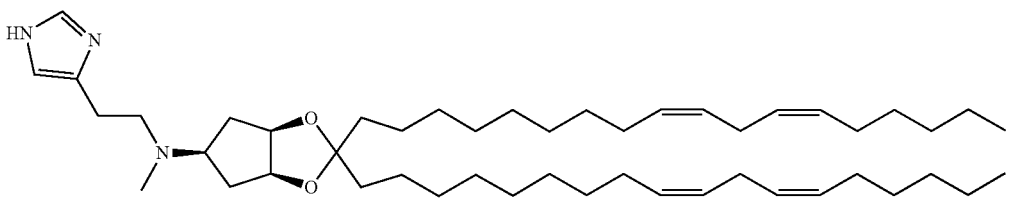 [SMILES: CCCCC/C=C\C/C=C\CCCCCCCCC1(CCCCCCCC/C=C\C/C=C\CCCCC)O[C@H]2C[C@@H](N(C)CCc3c[nH]cn3)C[C@H]2O1]
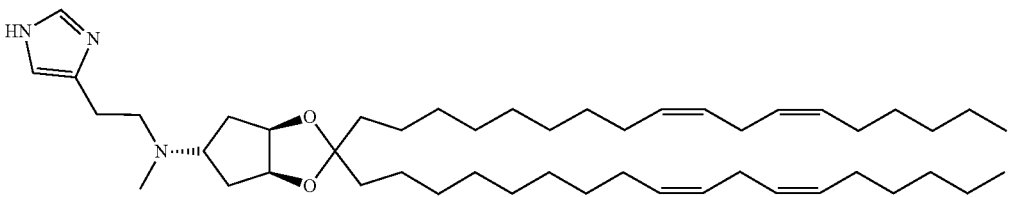
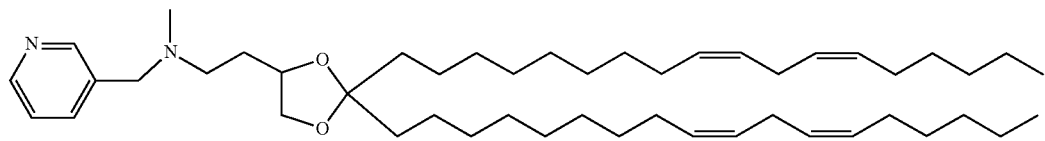
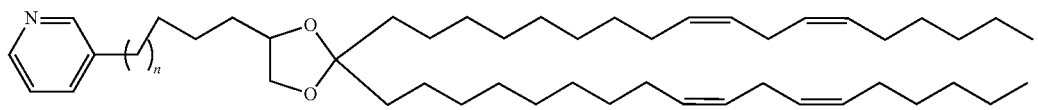
n = 1-10
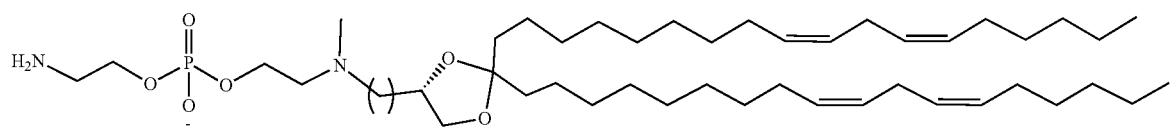
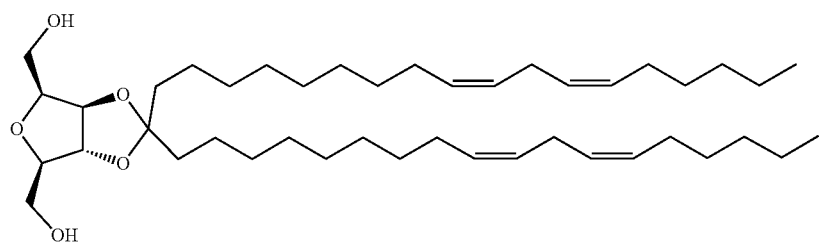 [SMILES: CCCCC/C=C\C/C=C\CCCCCCCCC1(CCCCCCCC/C=C\C/C=C\CCCCC)O[C@H]2[C@H](O1)[C@@H](CO)O[C@H]2CO]
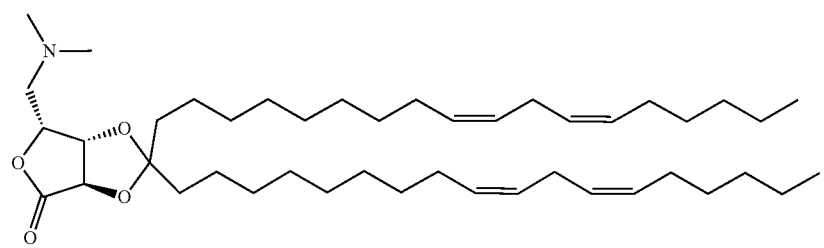 [SMILES: CCCCC/C=C\C/C=C\CCCCCCCCC1(CCCCCCCC/C=C\C/C=C\CCCCC)O[C@H]2[C@@H](CN(C)C)OC(=O)[C@@H]2O1]
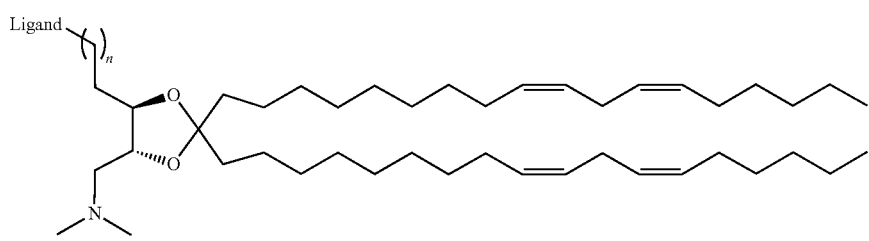

TABLE 11-continued
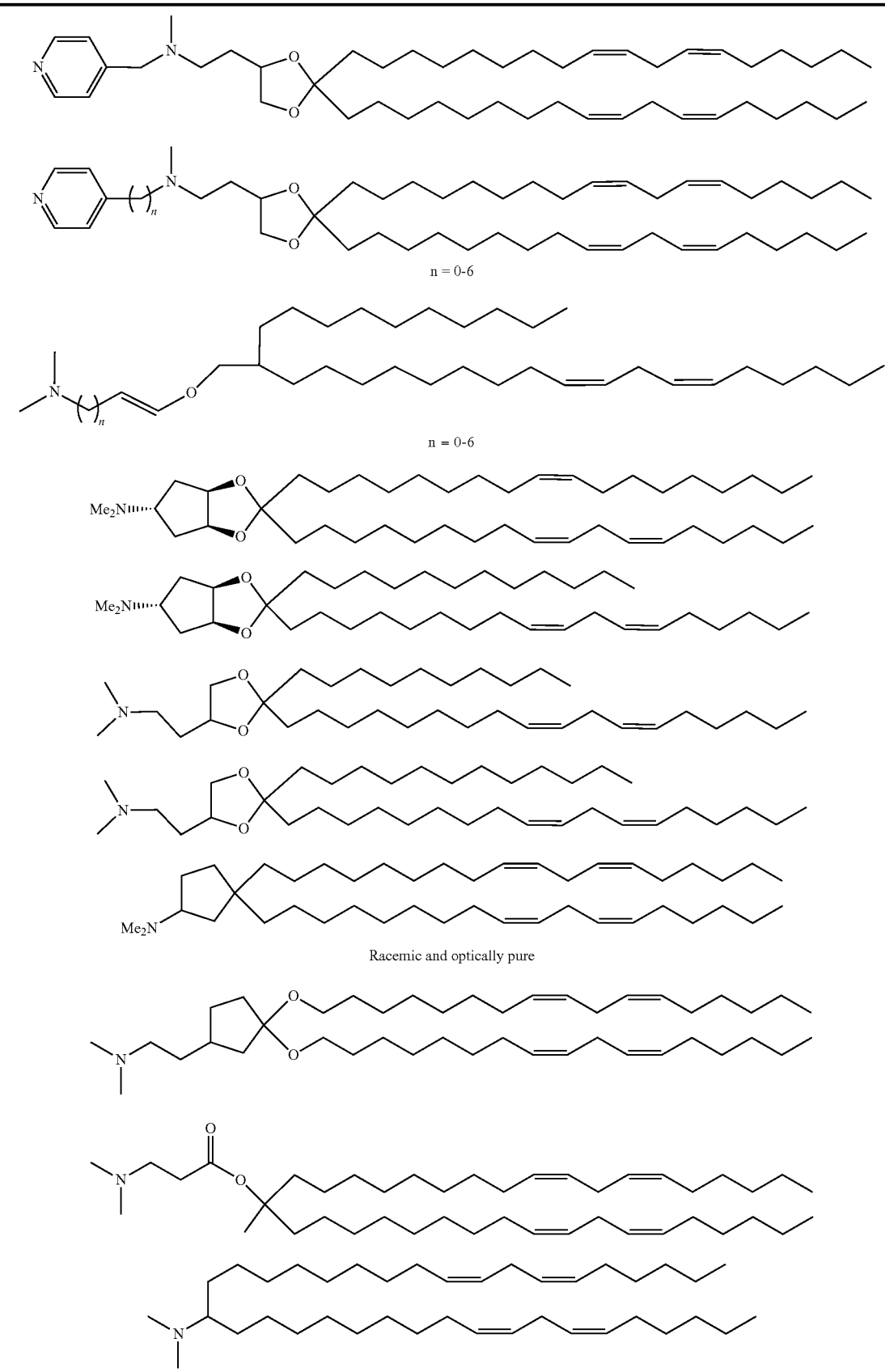

TABLE 11-continued
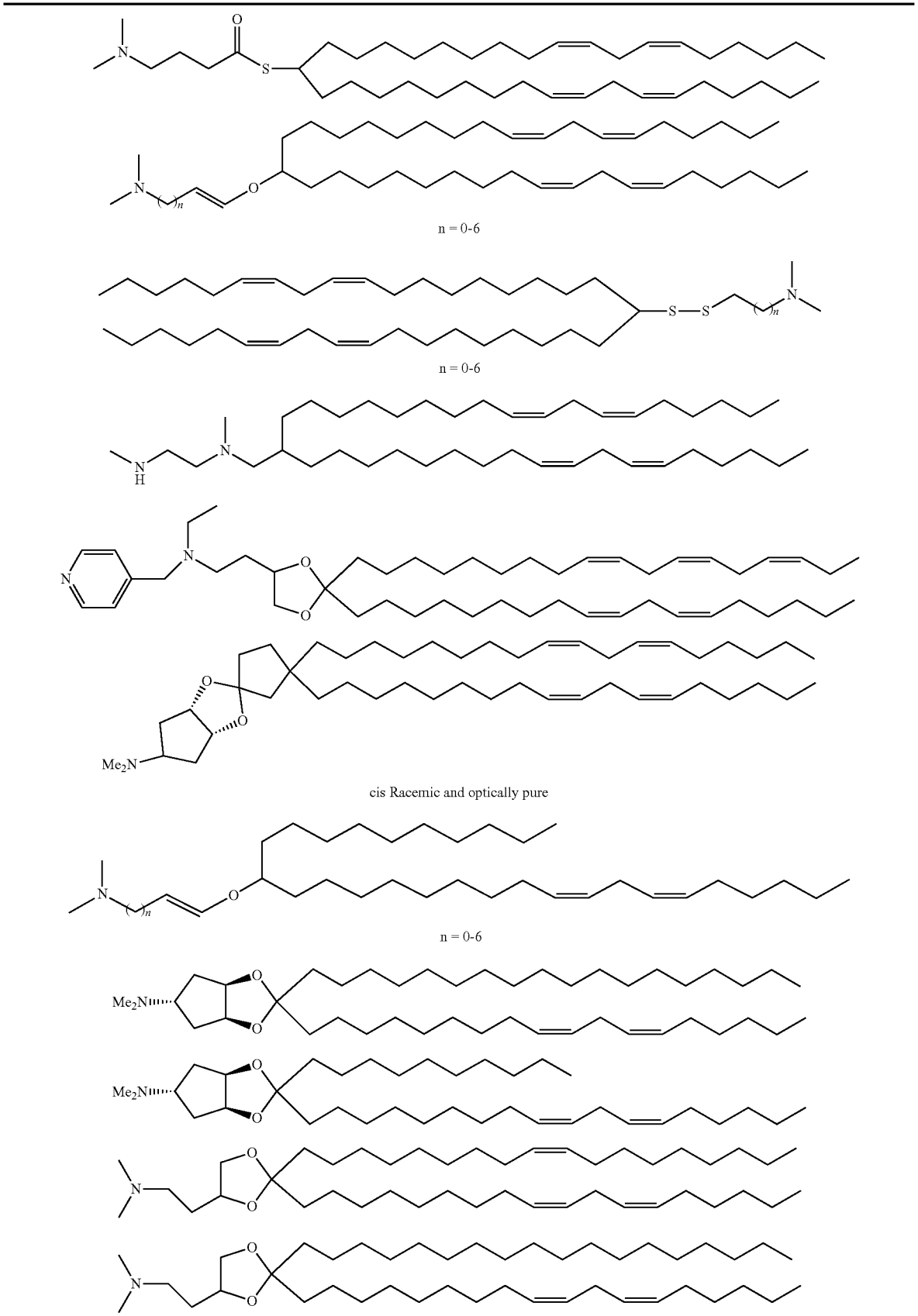

TABLE 11-continued
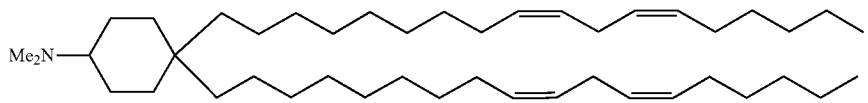
Racemic and optically pure
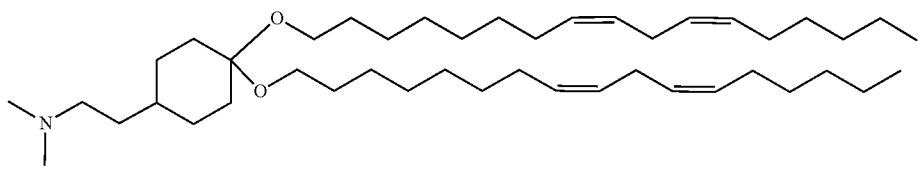 [SMILES: CCCCC/C=C\C/C=C\CCCCCCCOC1(OCCCCCCC/C=C\C/C=C\CCCCC)CCC(CCN(C)C)CC1]
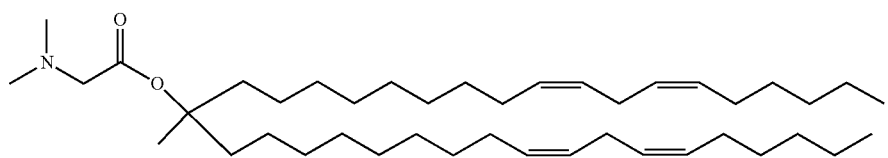 [SMILES: CCCCC/C=C\C/C=C\CCCCCCCCC(C)(CCCCCCCC/C=C\C/C=C\CCCCC)OC(=O)CN(C)C]
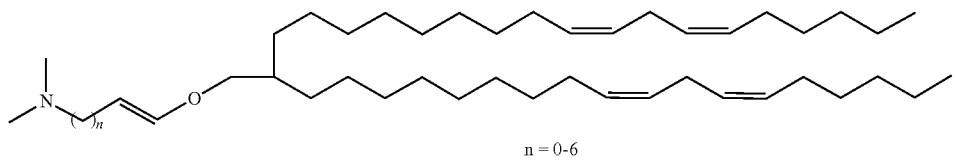
n = 0-6
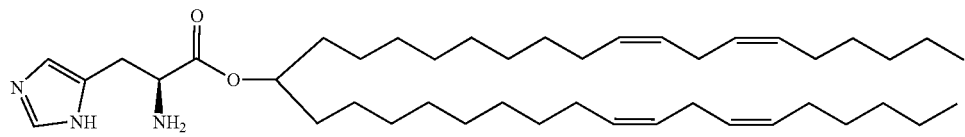
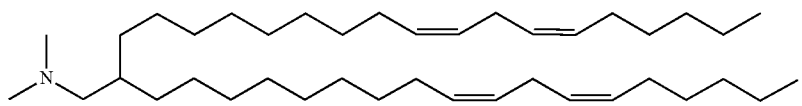 [SMILES: CCCCC/C=C\C/C=C\CCCCCCCCC(CCCCCCCC/C=C\C/C=C\CCCCC)CN(C)C]
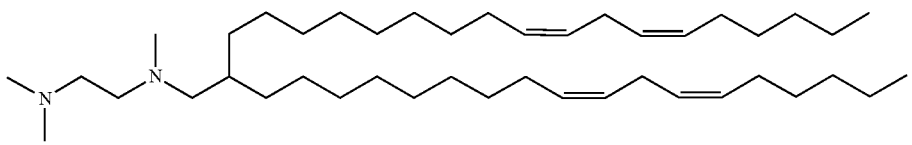
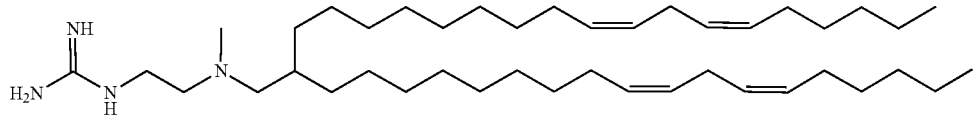 [SMILES: CCCCC/C=C\C/C=C\CCCCCCCCC(CCCCCCCC/C=C\C/C=C\CCCCC)CN(C)CCNC(=N)N]
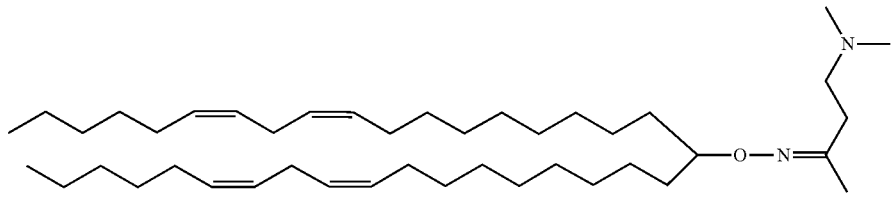 [SMILES: CCCCC/C=C\C/C=C\CCCCCCCCC(CCCCCCCC/C=C\C/C=C\CCCCC)ON=C(C)CCN(C)C]
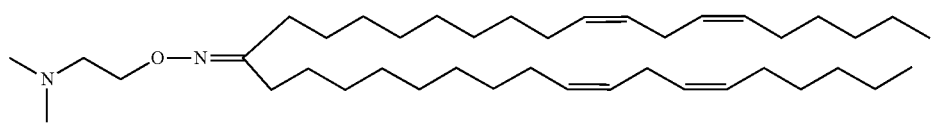 [SMILES: CCCCC/C=C\C/C=C\CCCCCCCCC(CCCCCCCC/C=C\C/C=C\CCCCC)=NOCCN(C)C]

TABLE 11-continued
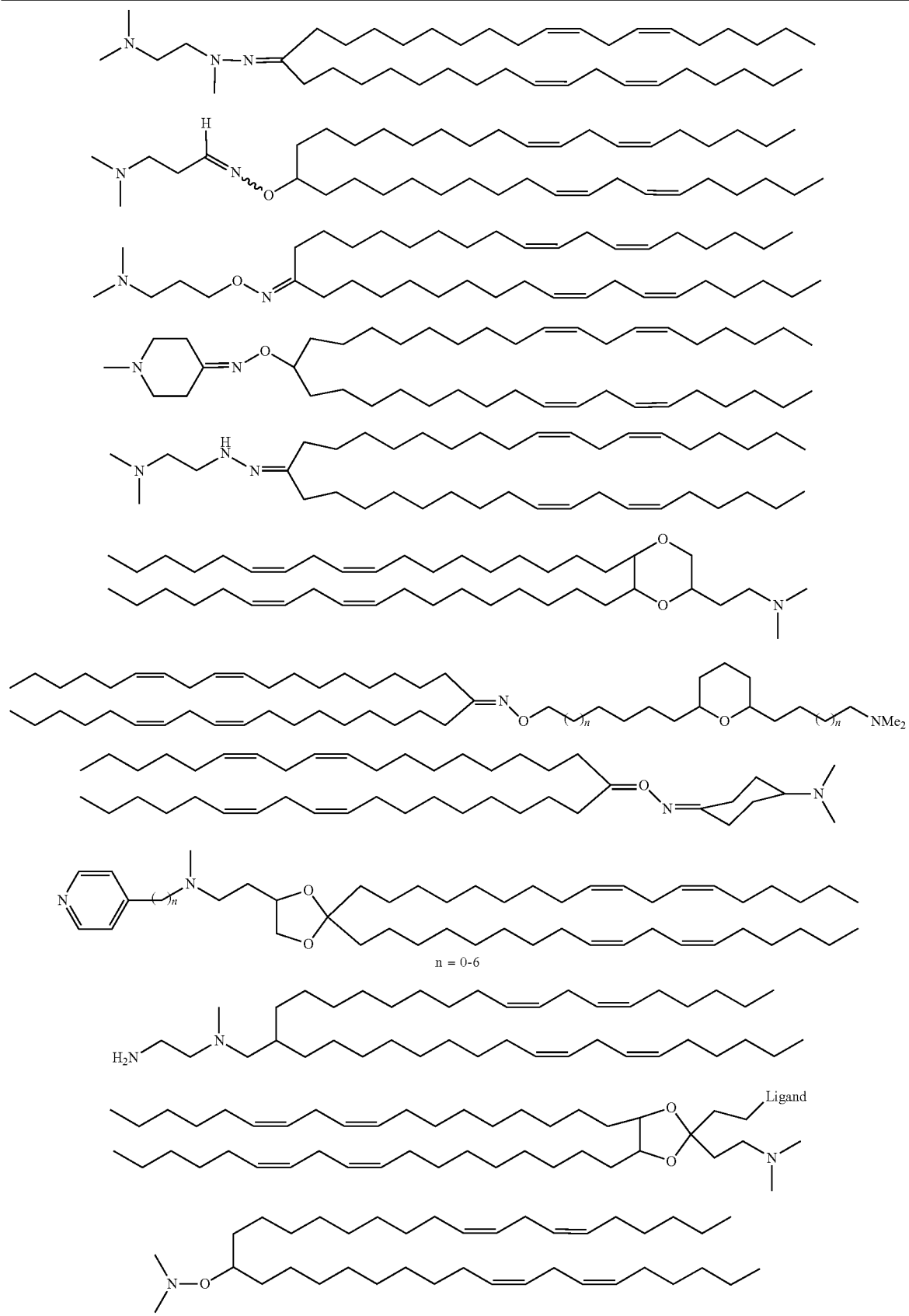

TABLE 11-continued
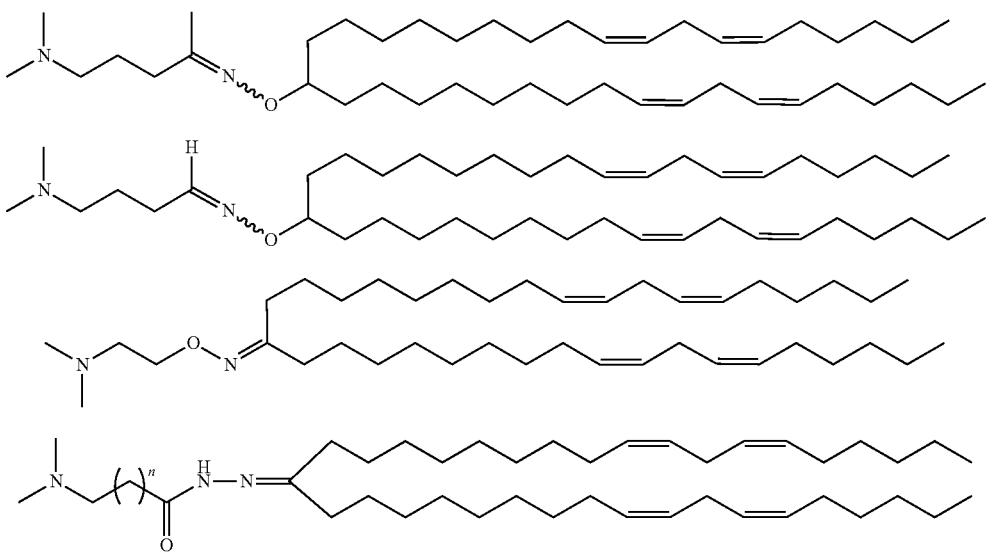
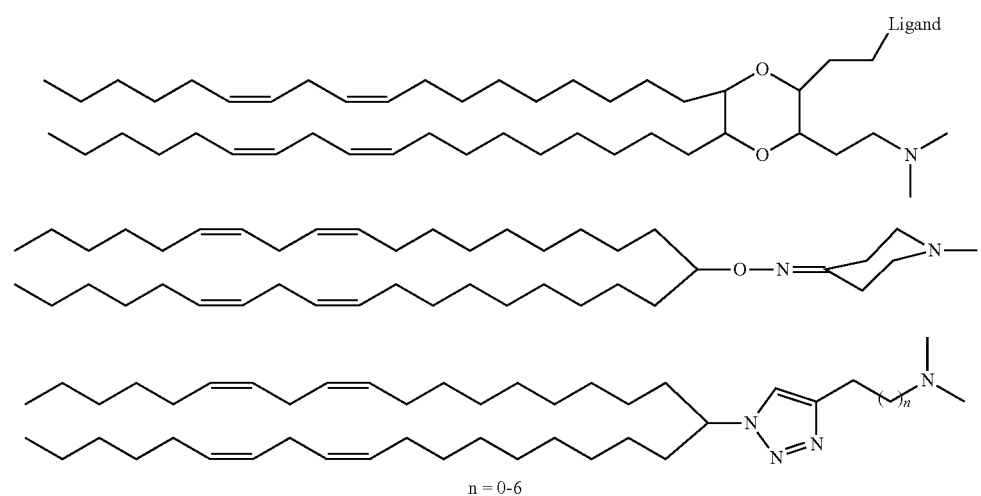
n = 0-6
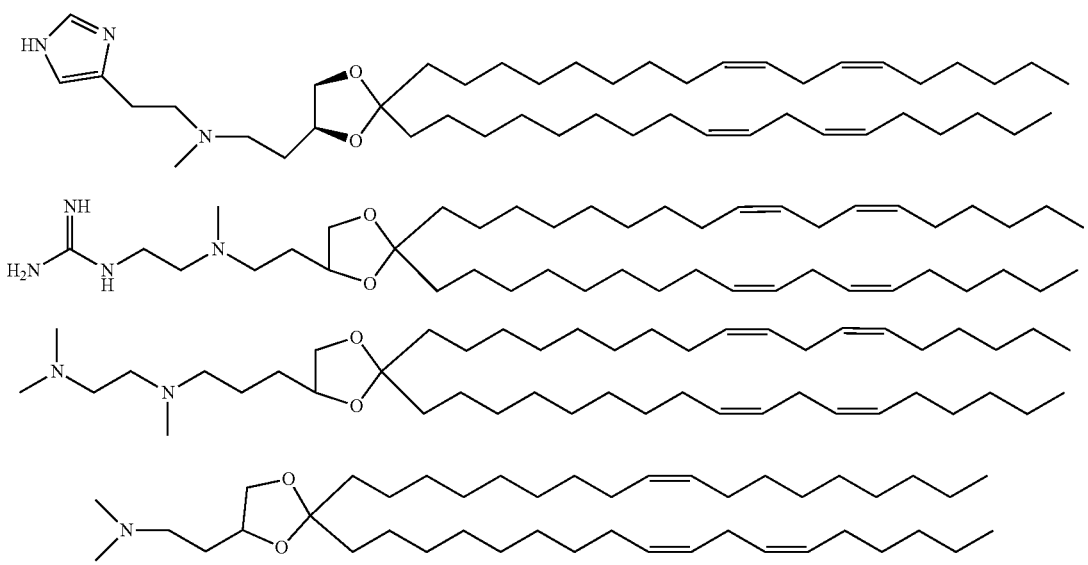

TABLE 11-continued
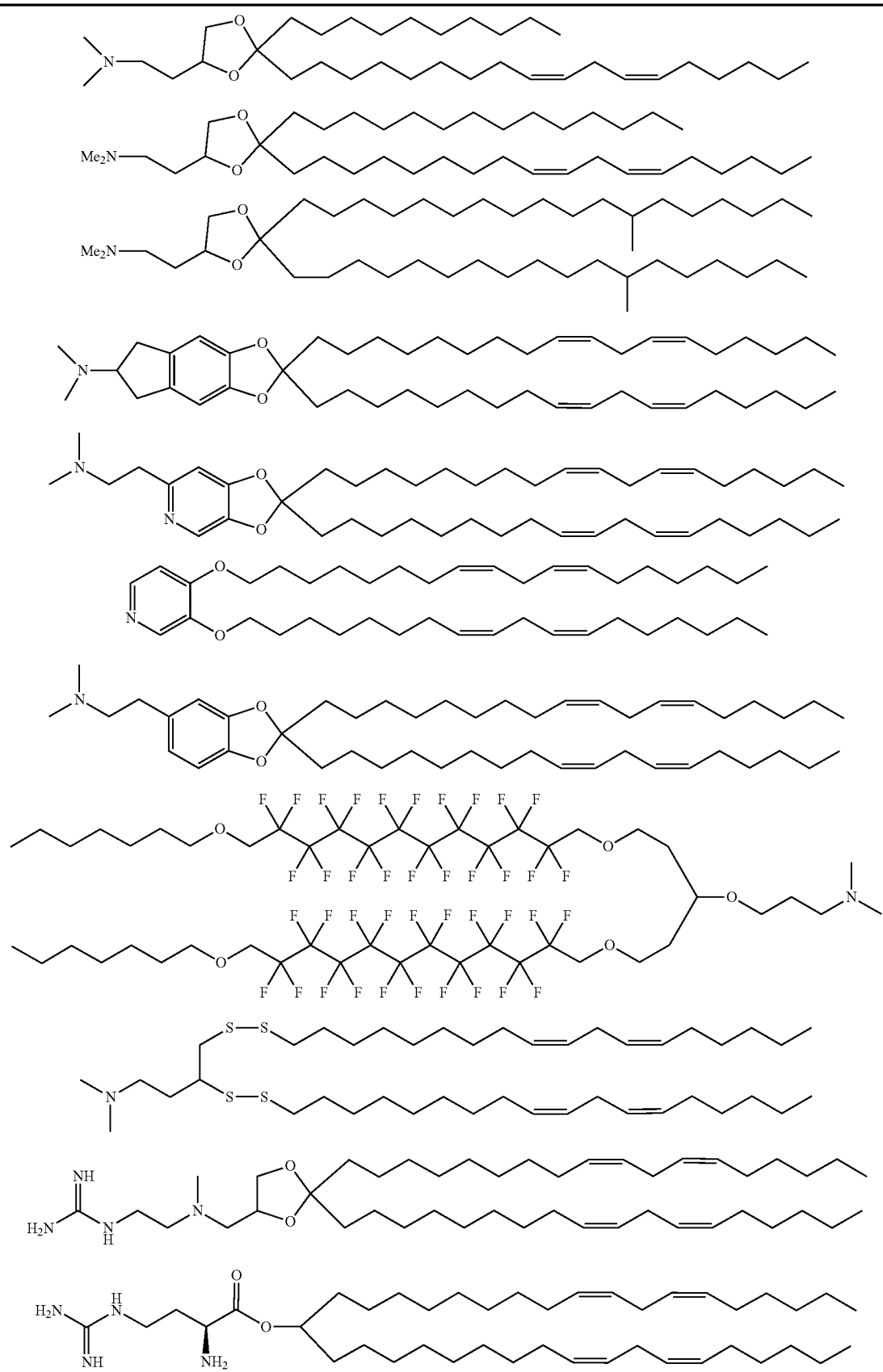

TABLE 11-continued
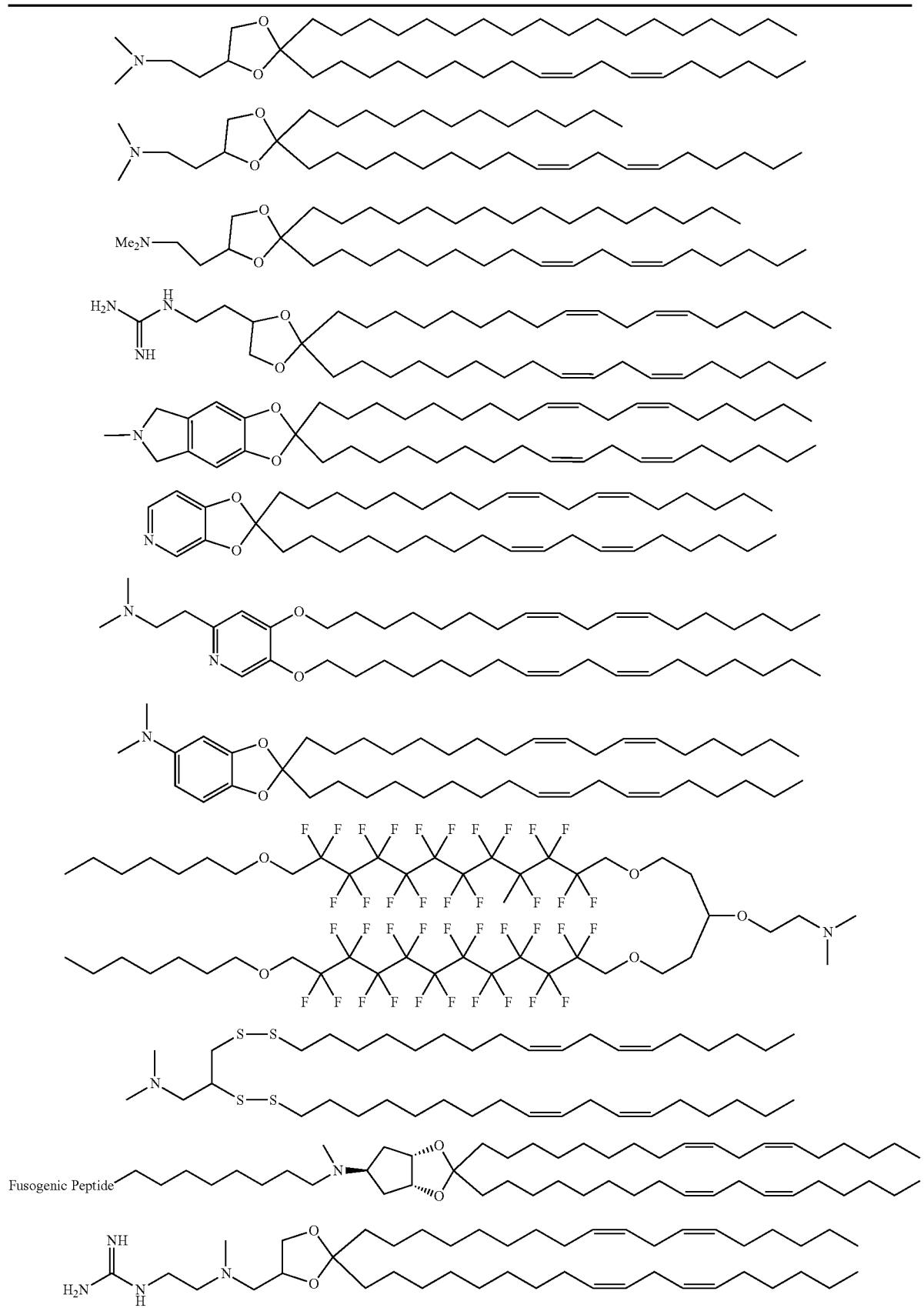

TABLE 11-continued
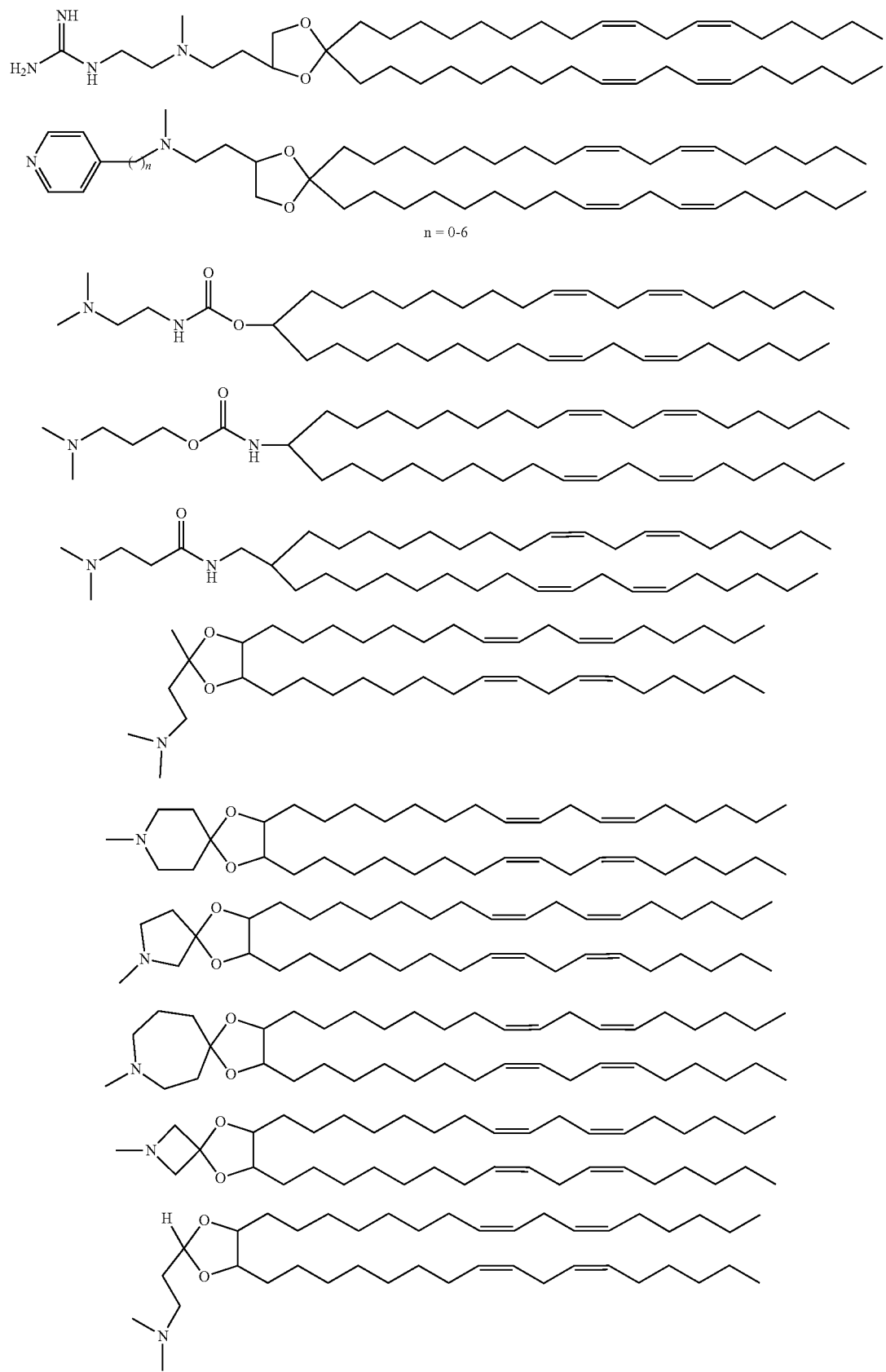
n = 0-6

TABLE 11-continued
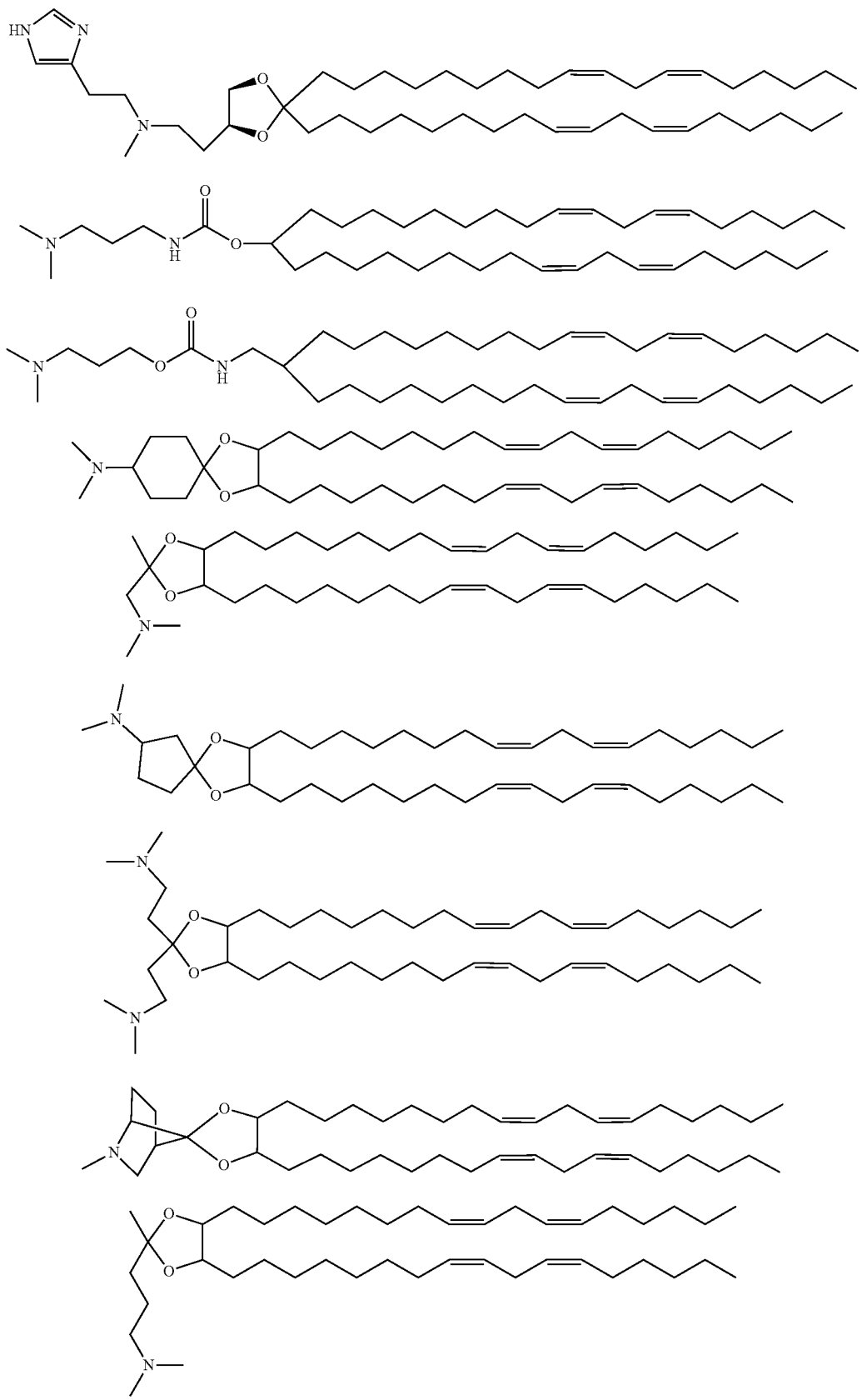

TABLE 11-continued
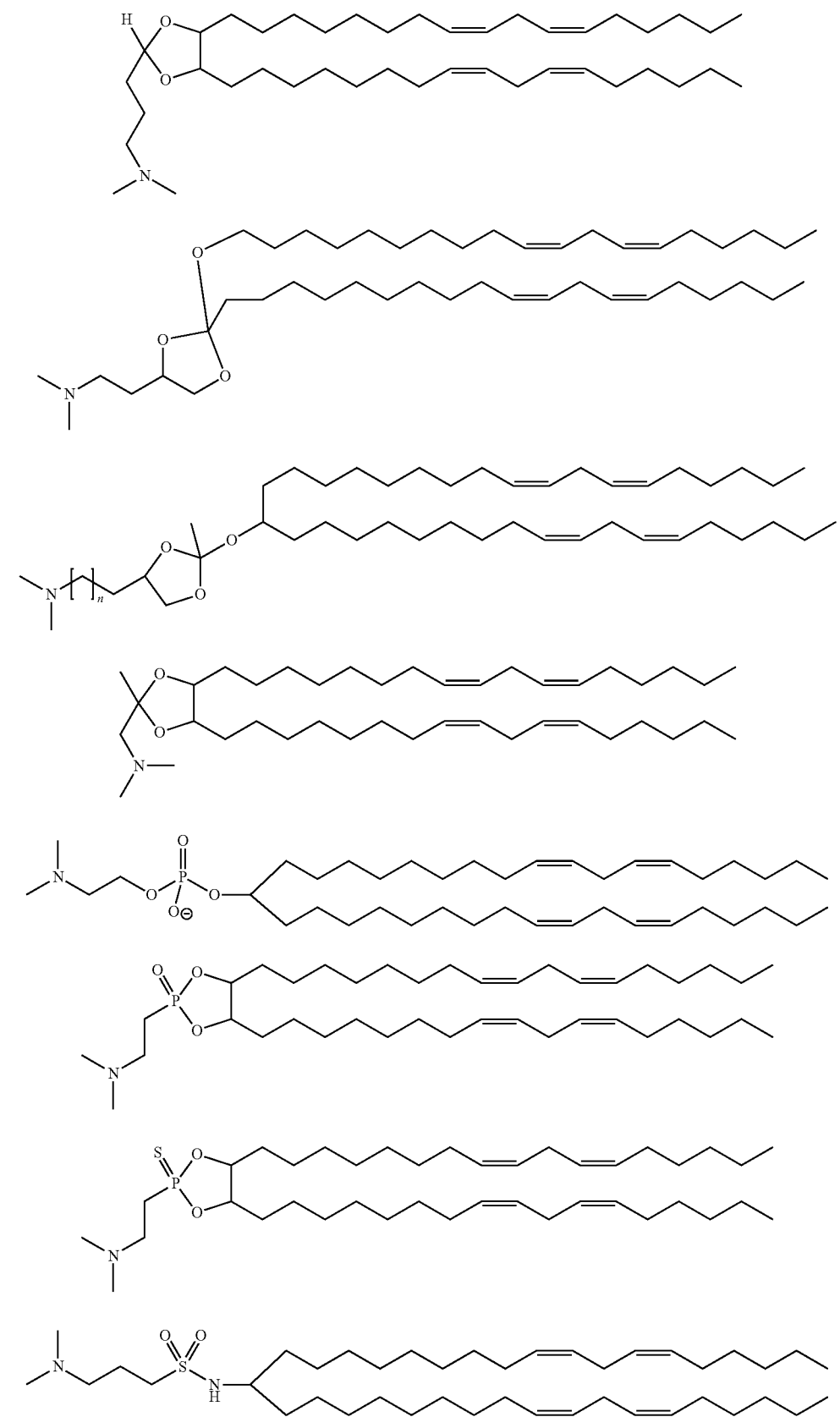

TABLE 11-continued
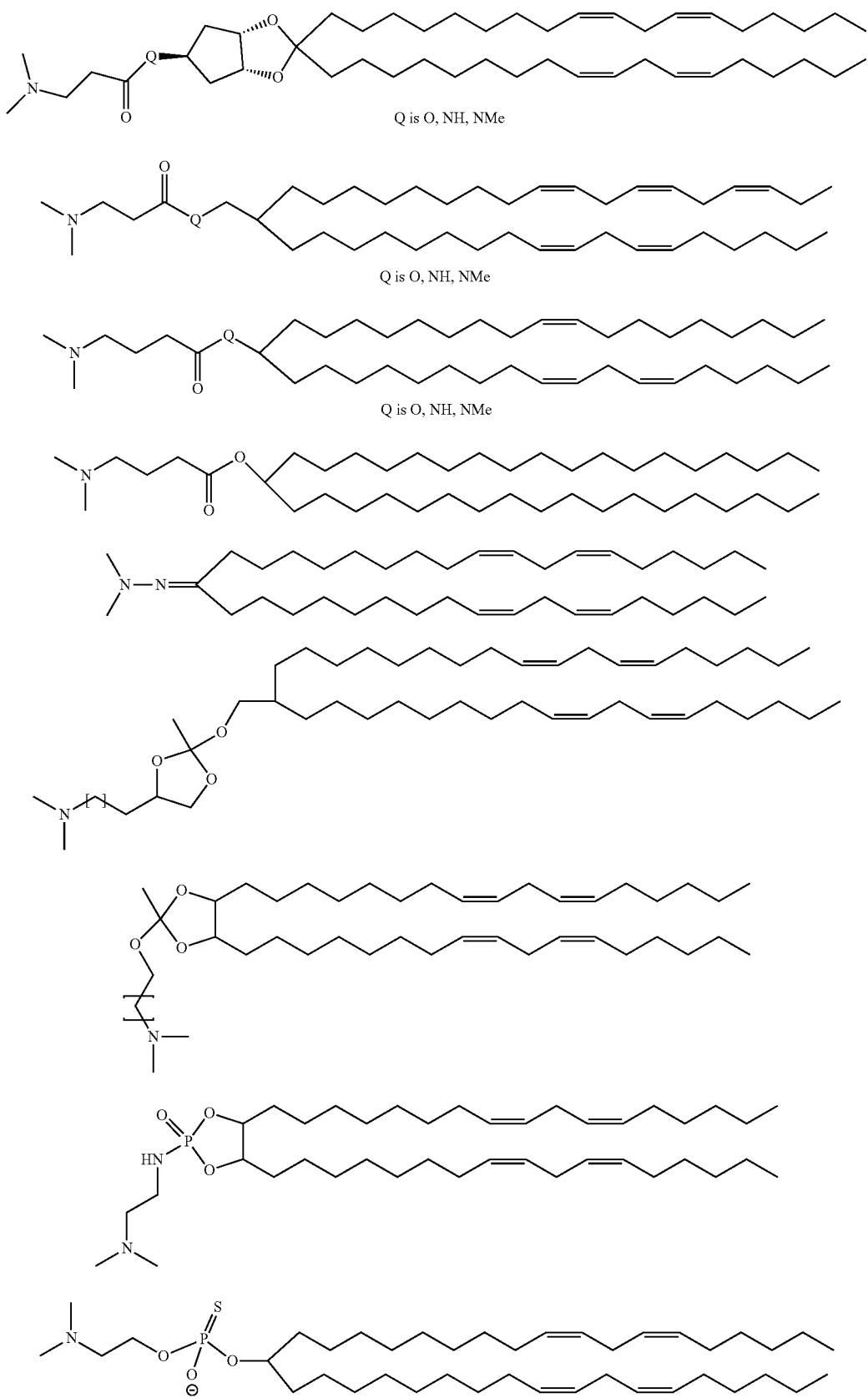
Q is O, NH, NMe
Q is O, NH, NMe
Q is O, NH, NMe

TABLE 11-continued
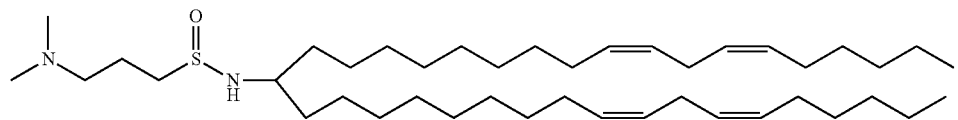 [SMILES: CCCCC/C=C\C/C=C\CCCCCCCCC(CCCCCCCC/C=C\C/C=C\CCCCC)NS(=O)CCCN(C)C]
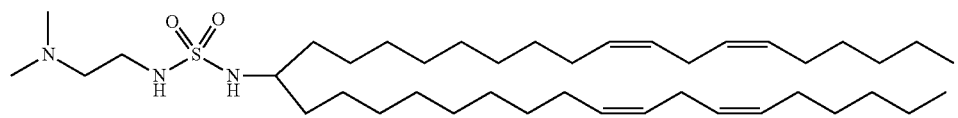
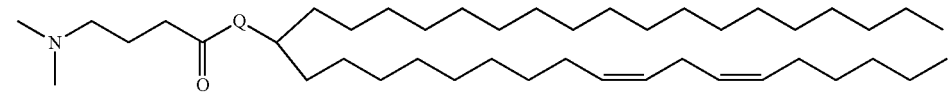
Q is O, NH, NMe
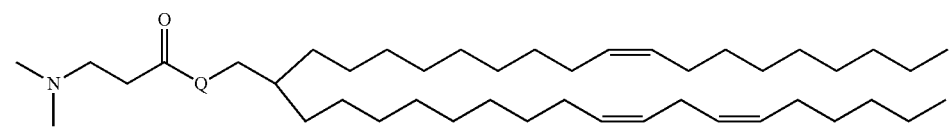
Q is O, NH, NMe
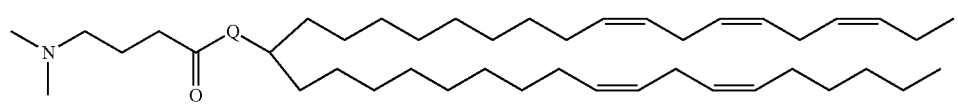
Q is O, NH, NMe
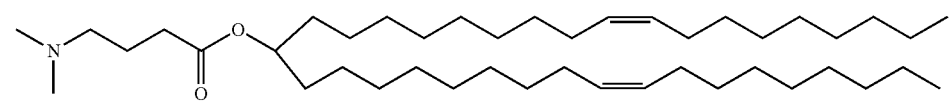 [SMILES: CCCCCCCC/C=C\CCCCCCCCC(CCCCCCCC/C=C\CCCCCCCC)OC(=O)CCCN(C)C]
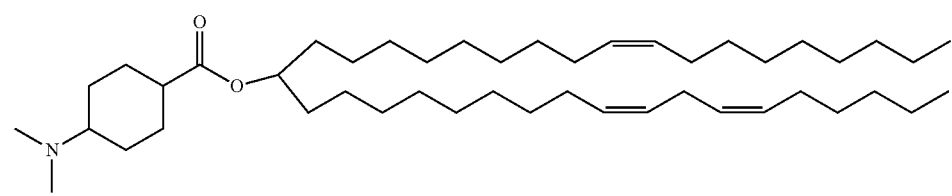 [SMILES: CCCCC/C=C\C/C=C\CCCCCCCCC(CCCCCCCC/C=C\CCCCCCCC)OC(=O)C1CCC(N(C)C)CC1]
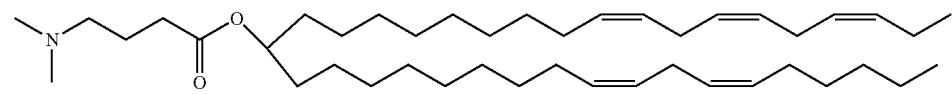 [SMILES: CC/C=C\C/C=C\C/C=C\CCCCCCCCC(CCCCCCCC/C=C\C/C=C\CCCCC)OC(=O)CCCN(C)C]
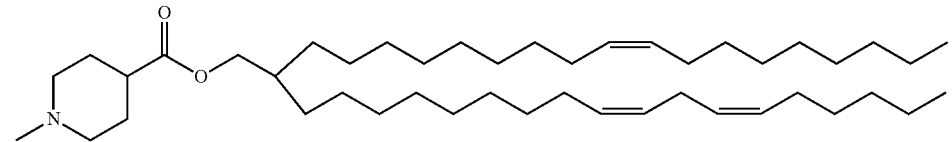 [SMILES: CCCCC/C=C\C/C=C\CCCCCCCCC(CCCCCCCC/C=C\CCCCCCCC)COC(=O)C1CCN(C)CC1]
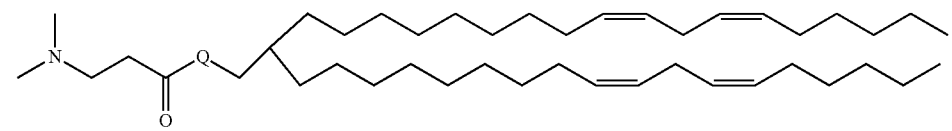
Q is O, NH, NMe TABLE 11-continued
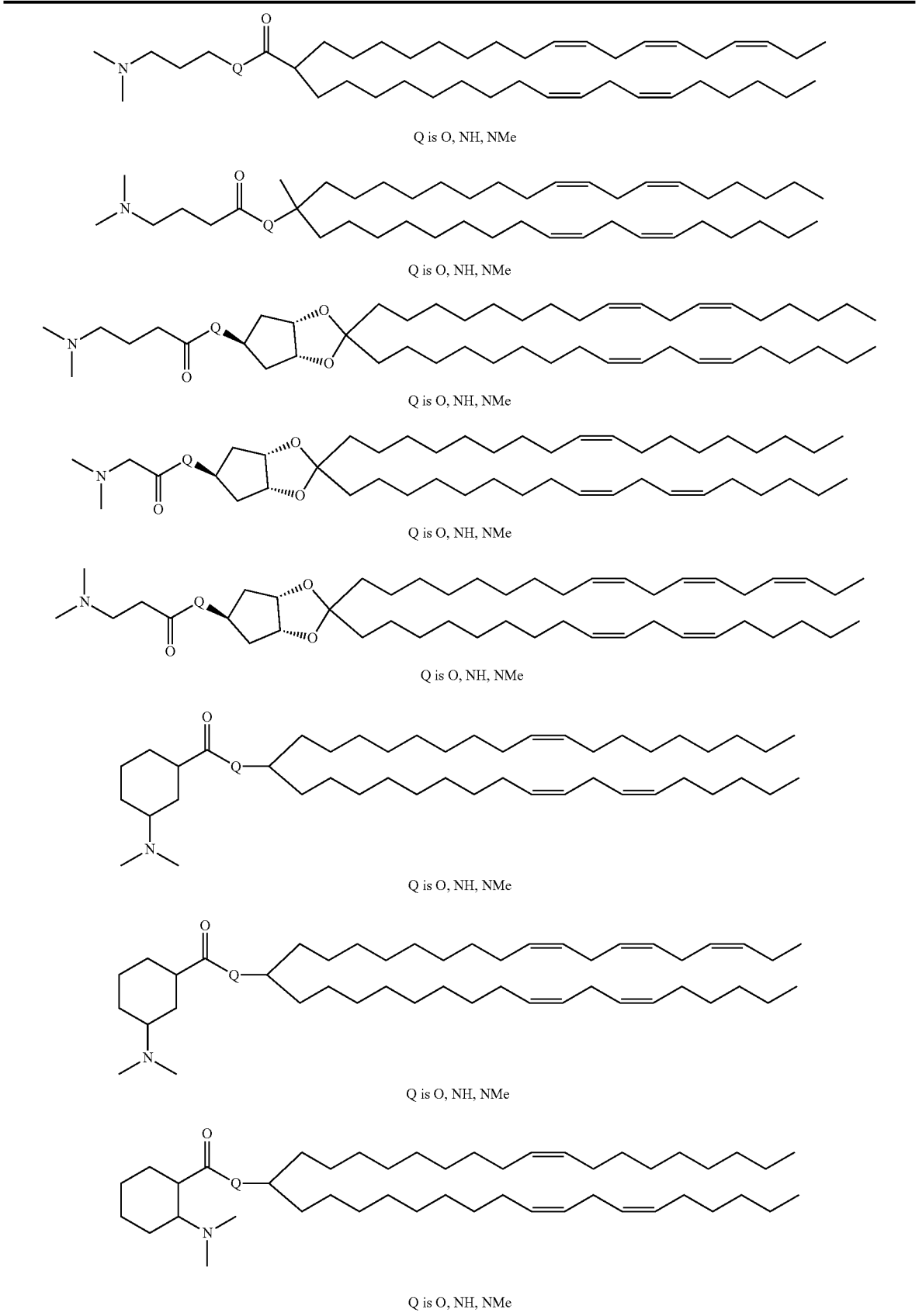
Q is O, NH, NMe
Q is O, NH, NMe
Q is O, NH, NMe
Q is O, NH, NMe
Q is O, NH, NMe
Q is O, NH, NMe
Q is O, NH, NMe
Q is O, NH, NMe TABLE 11-continued
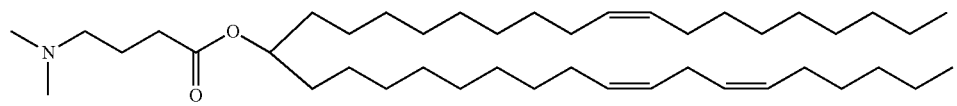
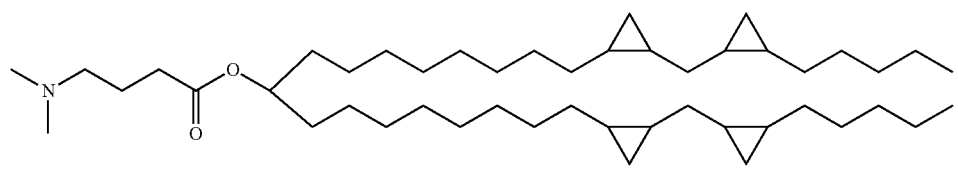 [SMILES: CCCCCC1CC1CC1CC1CCCCCCCCC(CCCCCCCCC1CC1CC1CC1CCCCC)OC(=O)CCCN(C)C]
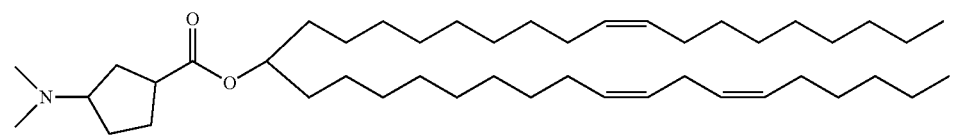 [SMILES: CCCCC/C=C\C/C=C\CCCCCCCCC(CCCCCCCC/C=C\CCCCCCCC)OC(=O)C1CCC(N(C)C)C1]
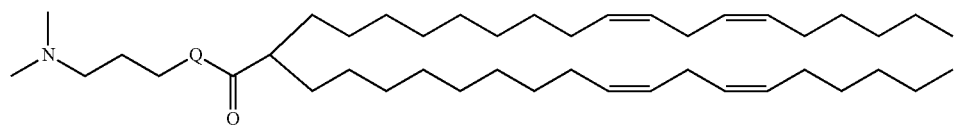
Q is O, NH, NMe
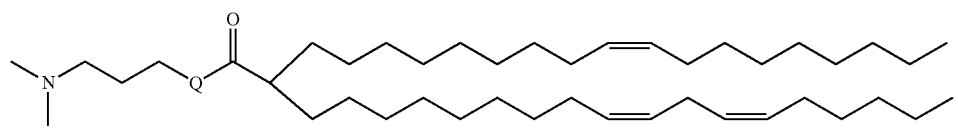
Q is O, NH, NMe
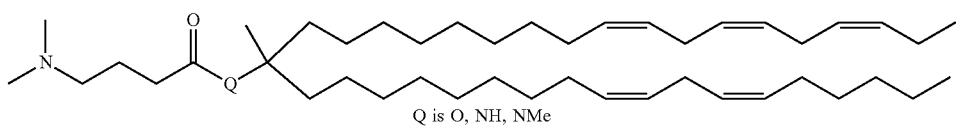
Q is O, NH, NMe
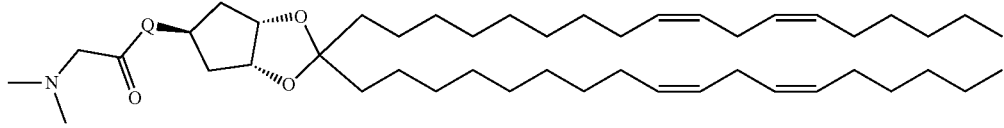
Q is O, NH, NMe
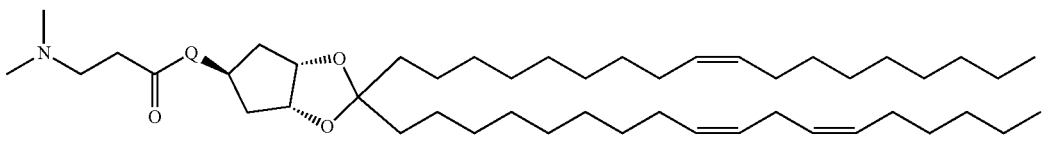
Q is O, NH, NMe
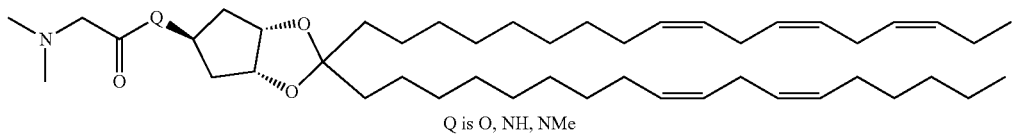
Q is O, NH, NMe TABLE 11-continued
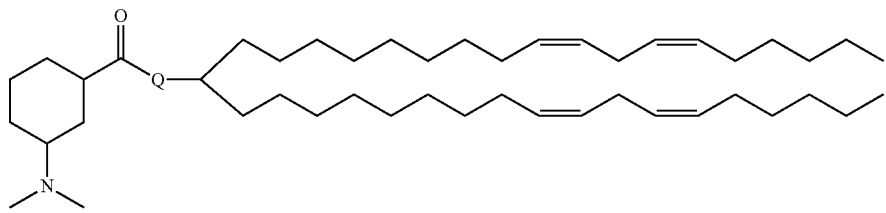
Q is O, NH, NMe
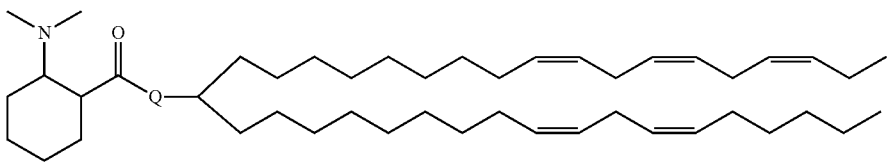
Q is O, NH, NMe
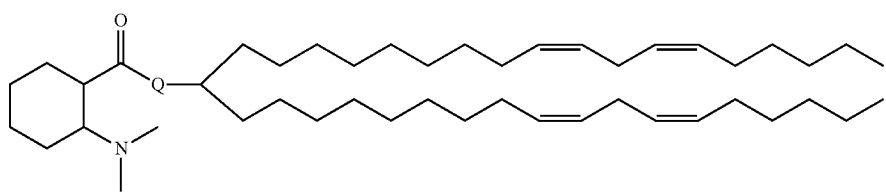
Q is O, NH, NMe
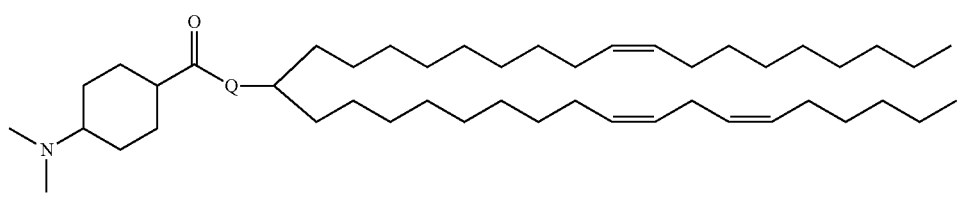
Q is O, NH, NMe
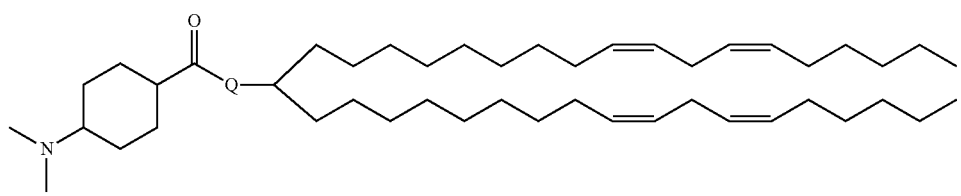
Q is O, NH, NMe
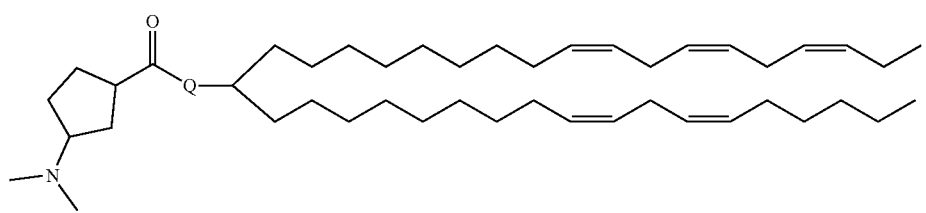
Q is O, NH, NMe
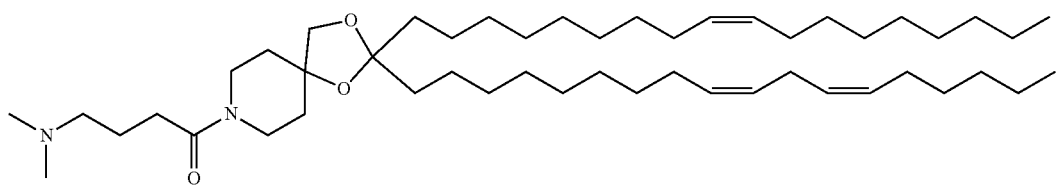 [SMILES: CCCCC/C=C\C/C=C\CCCCCCCCC1(CCCCCCCC/C=C\CCCCCCCC)OCC2(CCN(C(=O)CCCN(C)C)CC2)O1]

TABLE 11-continued
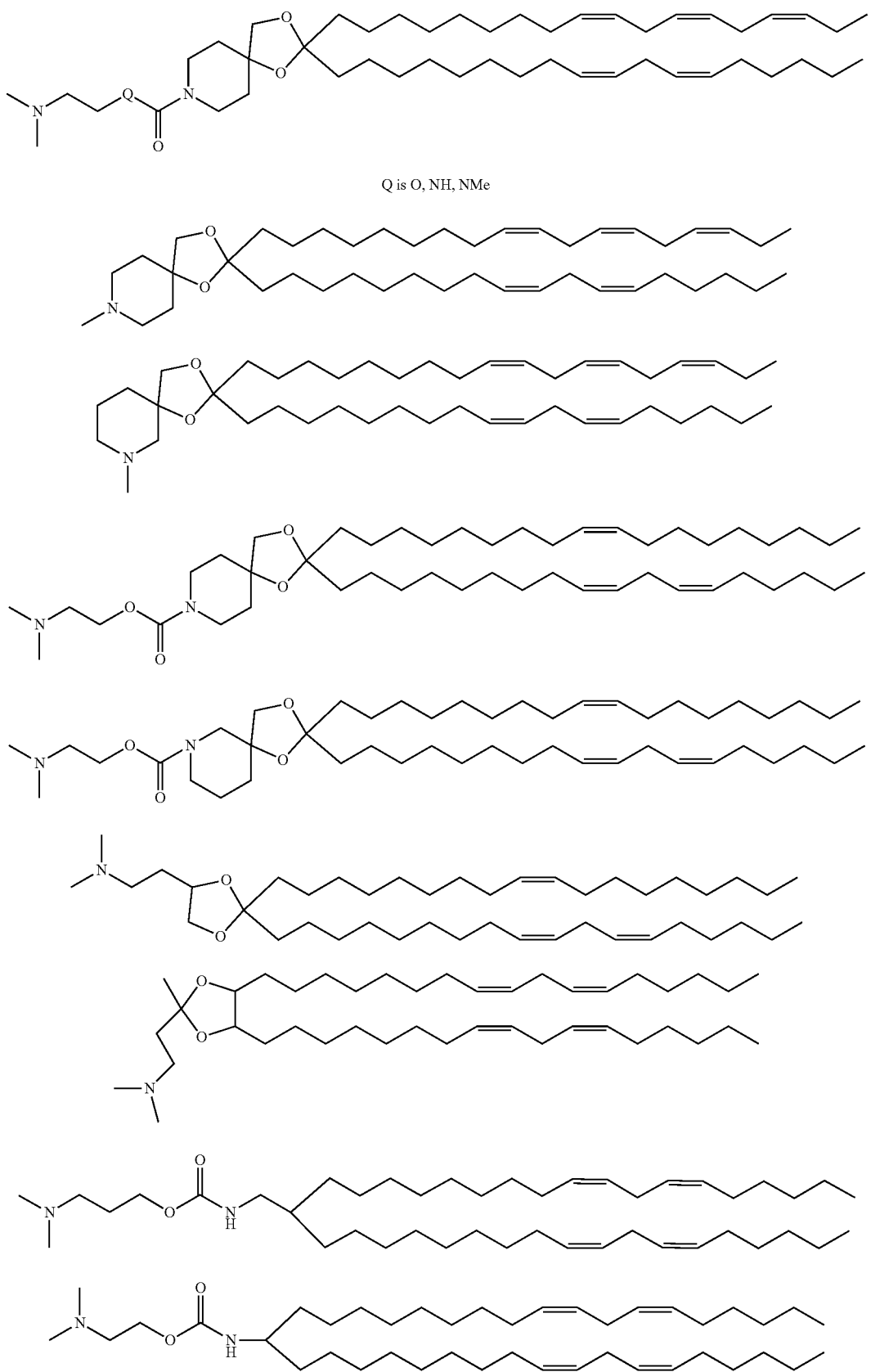
Q is O, NH, NMe

TABLE 11-continued
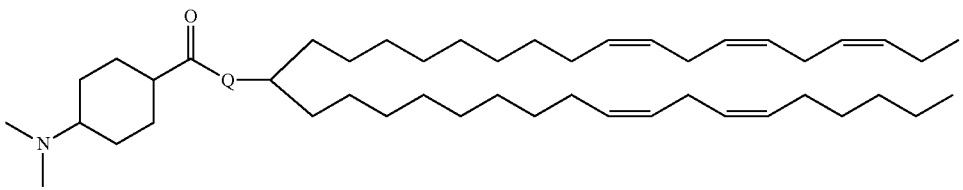
Q is O, NH, NMe
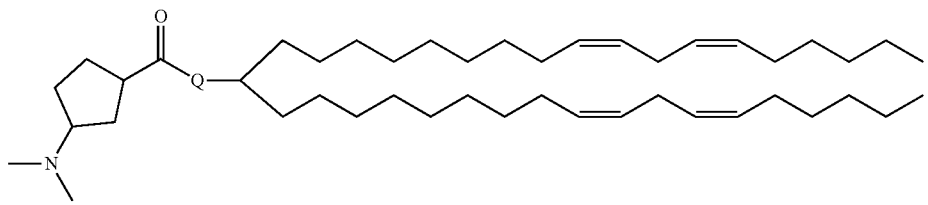
Q is O, NH, NMe
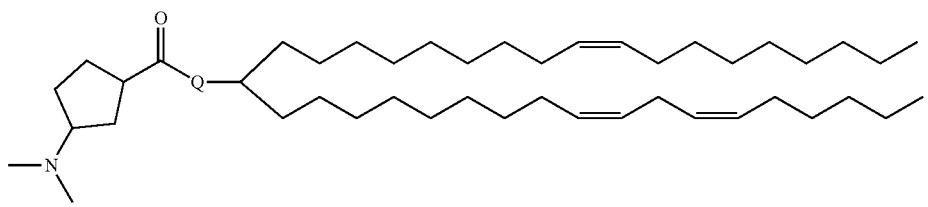
Q is O, NH, NMe
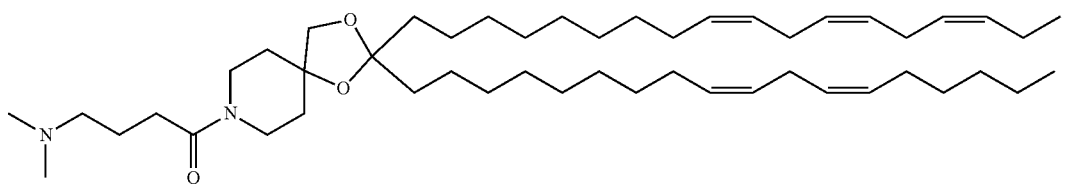 [SMILES: CC/C=C\C/C=C\C/C=C\CCCCCCCCC1(CCCCCCCC/C=C\C/C=C\CCCCC)OCC2(CCN(C(=O)CCCN(C)C)CC2)O1]
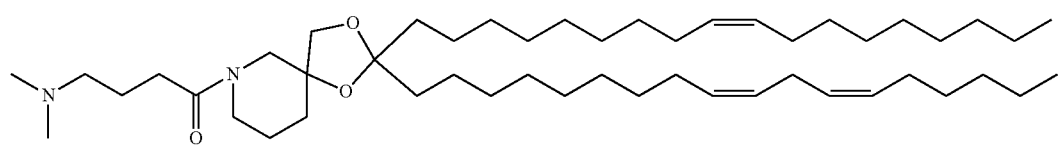 [SMILES: CCCCC/C=C\C/C=C\CCCCCCCCC1(CCCCCCCC/C=C\CCCCCCCC)OCC2(CCCN(C(=O)CCCN(C)C)C2)O1]
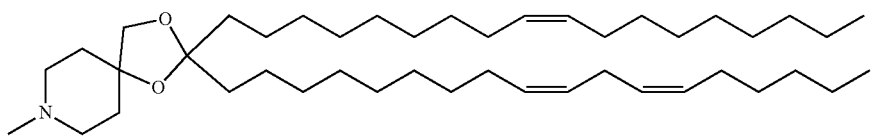 [SMILES: CCCCC/C=C\C/C=C\CCCCCCCCC1(CCCCCCCC/C=C\CCCCCCCC)OCC2(CCN(C)CC2)O1]
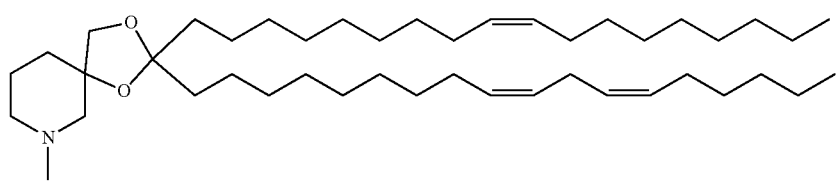 [SMILES: CCCCC/C=C\C/C=C\CCCCCCCCC1(CCCCCCCC/C=C\CCCCCCCC)OCC2(CCCN(C)C2)O1]
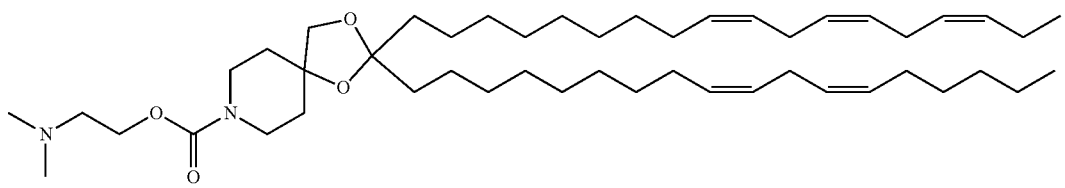 [SMILES: CC/C=C\C/C=C\C/C=C\CCCCCCCCC1(CCCCCCCC/C=C\C/C=C\CCCCC)OCC2(CCN(C(=O)OCCN(C)C)CC2)O1]

TABLE 11-continued
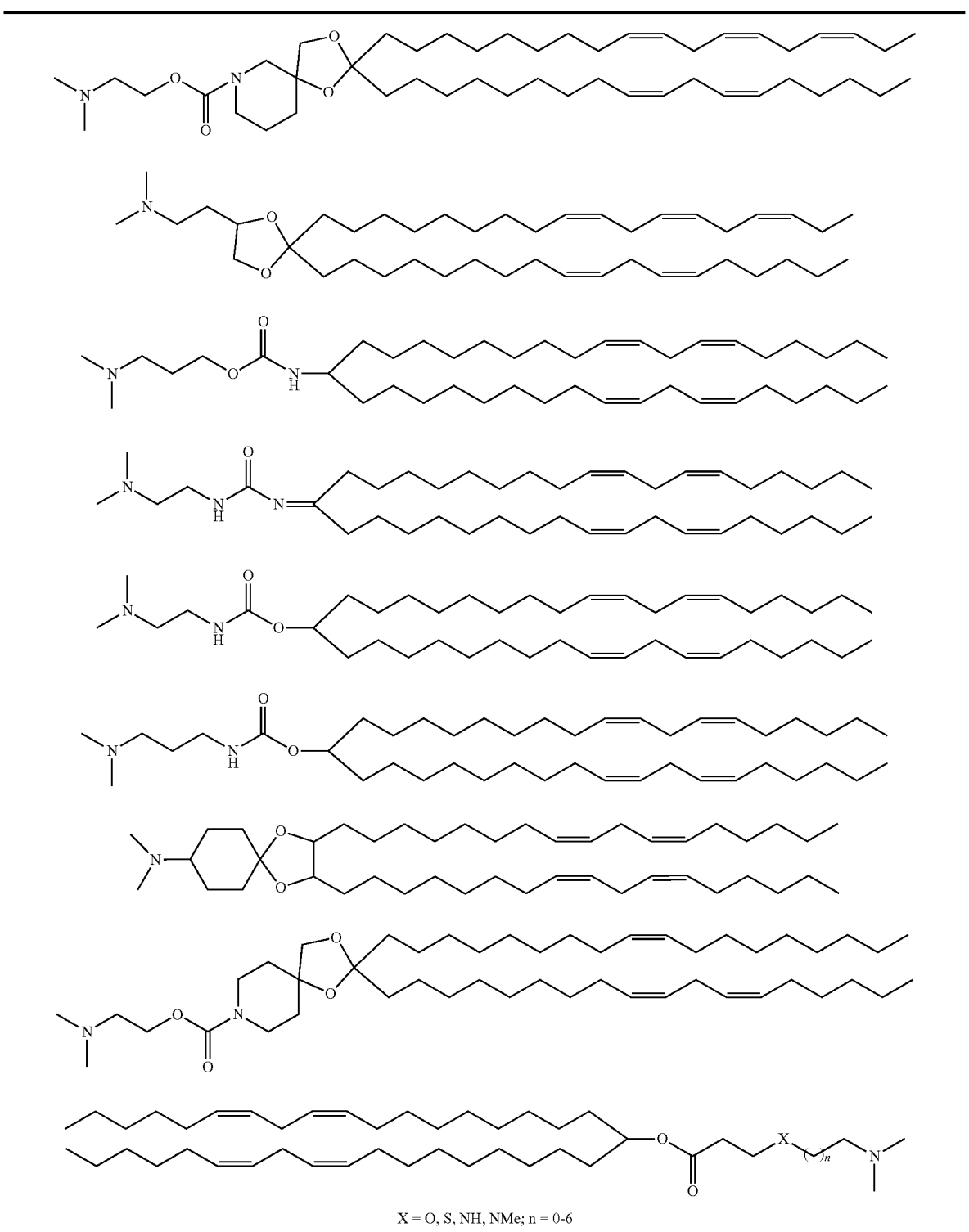
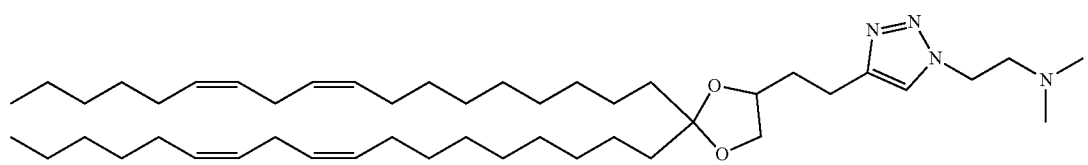 [SMILES: CCCCC/C=C\C/C=C\CCCCCCCCC1(CCCCCCCC/C=C\C/C=C\CCCCC)OCC(CCc2cn(CCN(C)C)nn2)O1]
X = O, S, NH, NMe; n = 0-6

TABLE 11-continued
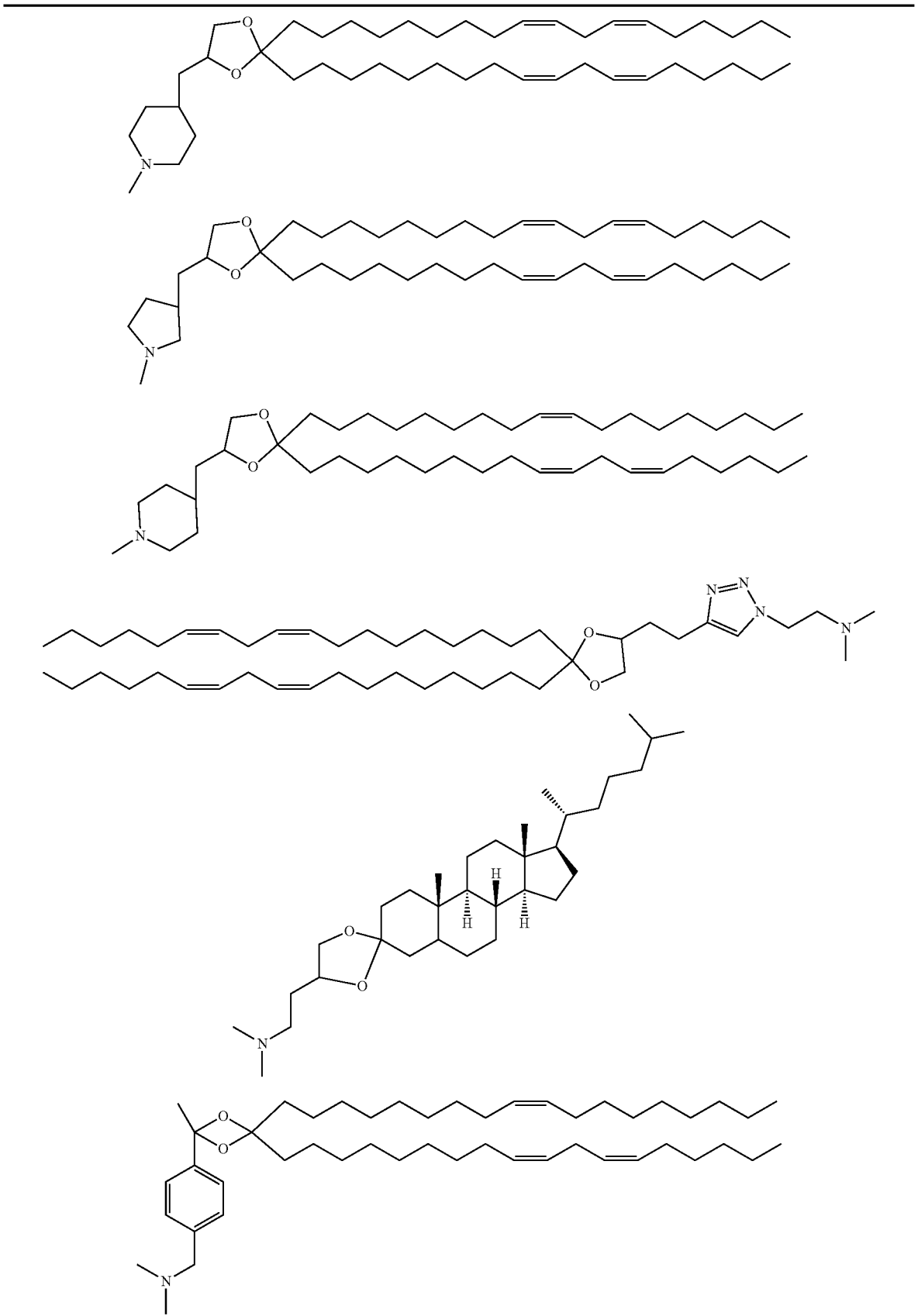

TABLE 11-continued
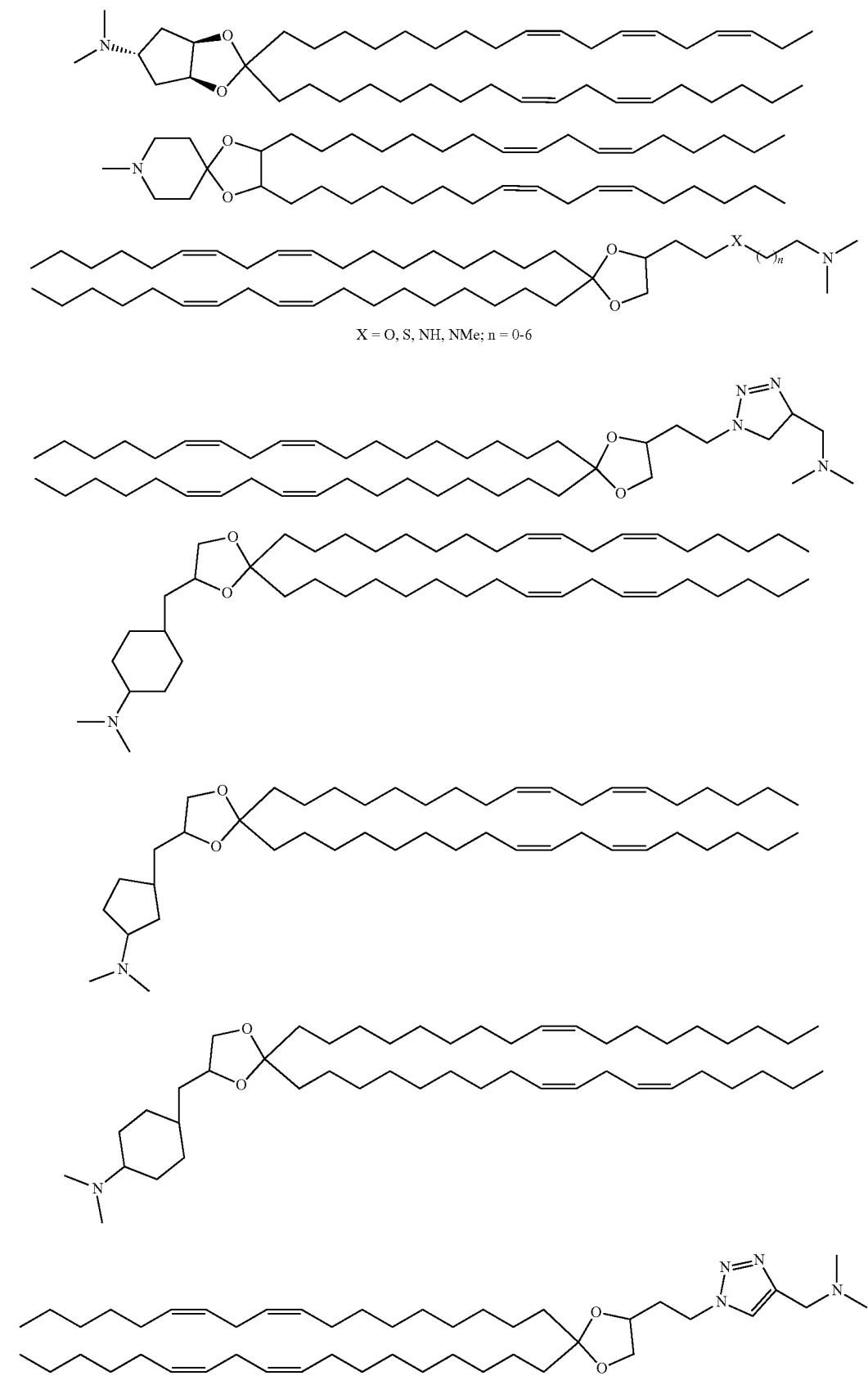
X = O, S, NH, NMe; n = 0-6

TABLE 11-continued
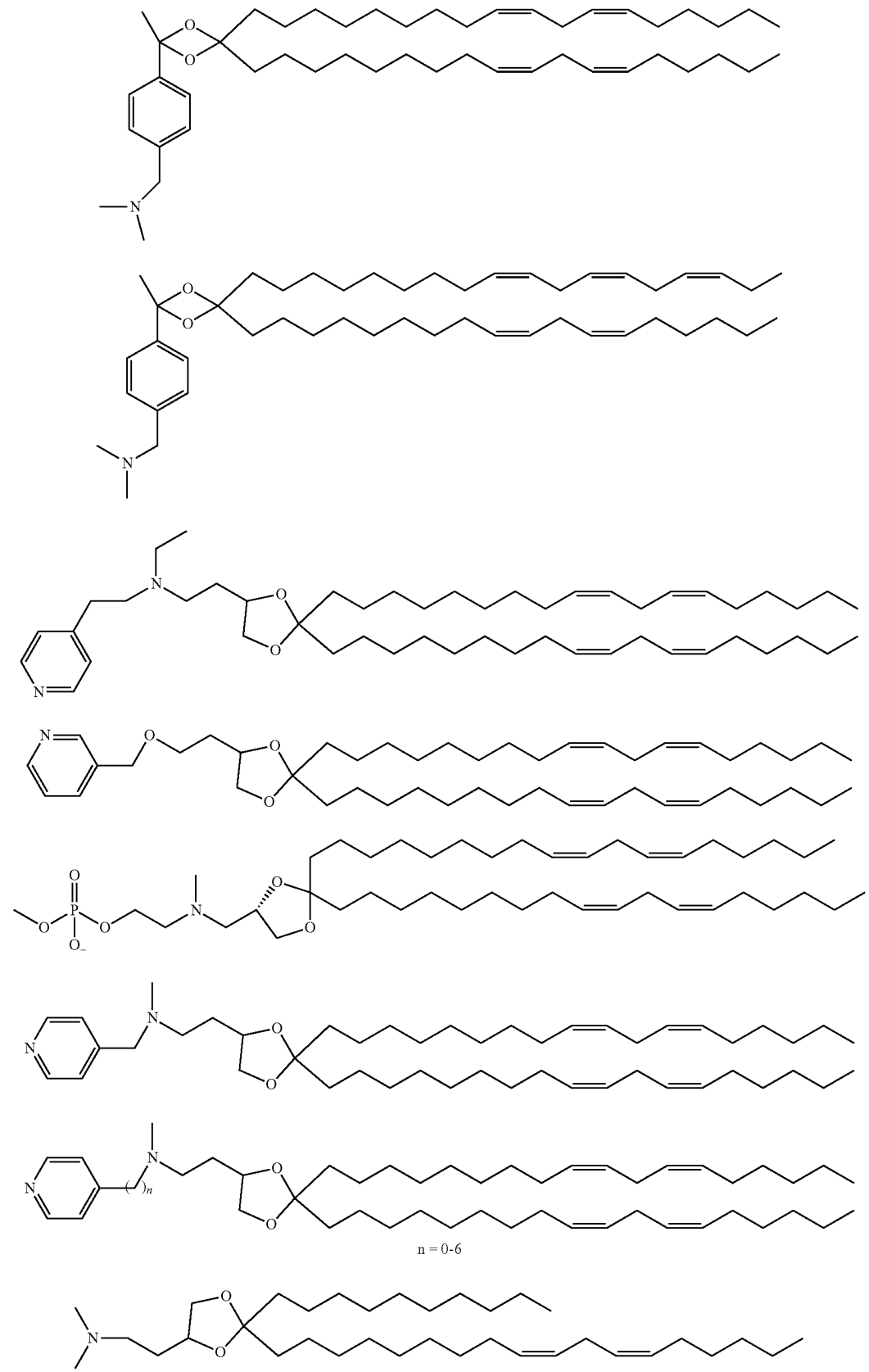

TABLE 11-continued
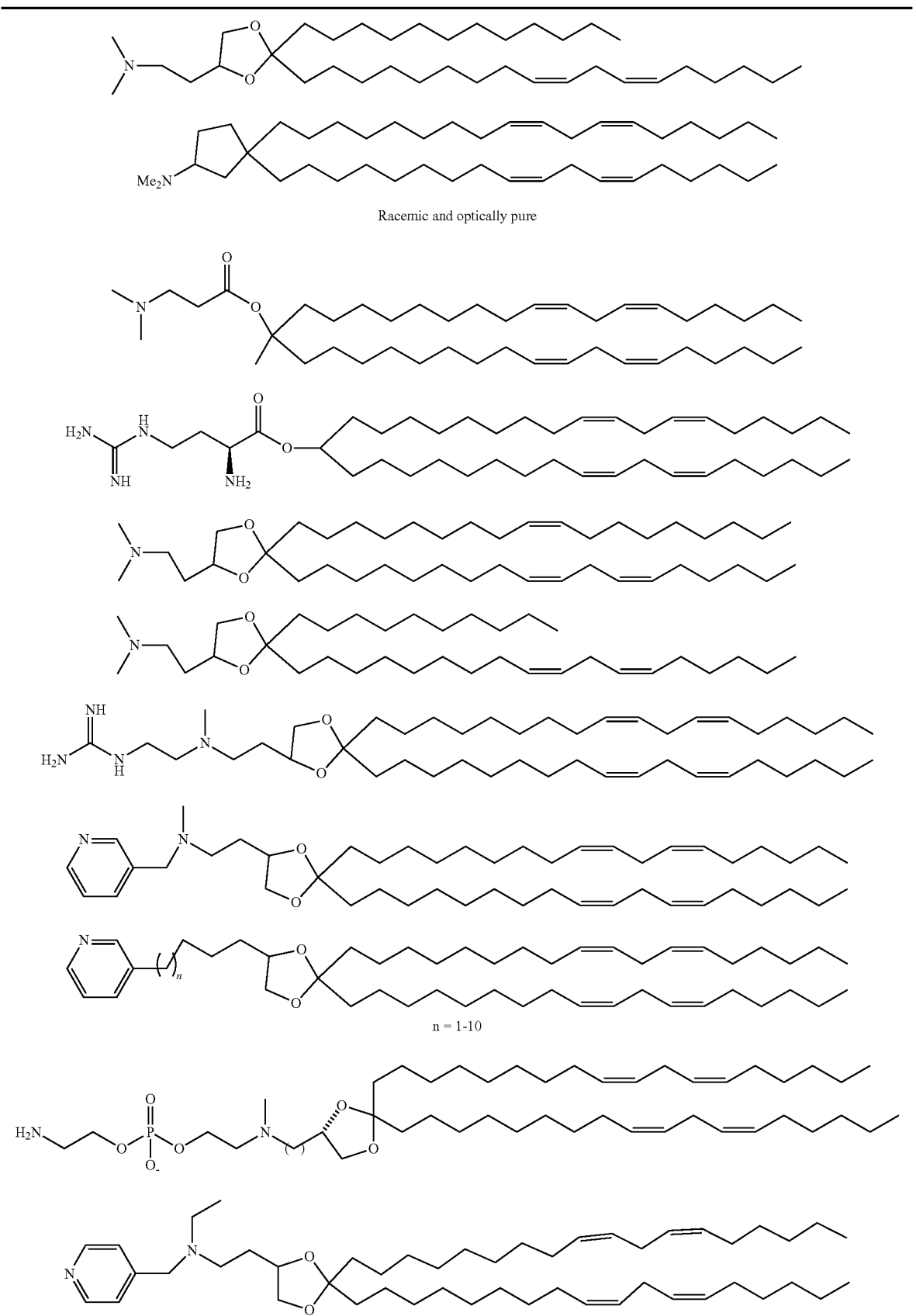
Racemic and optically pure
n = 1-10

TABLE 11-continued
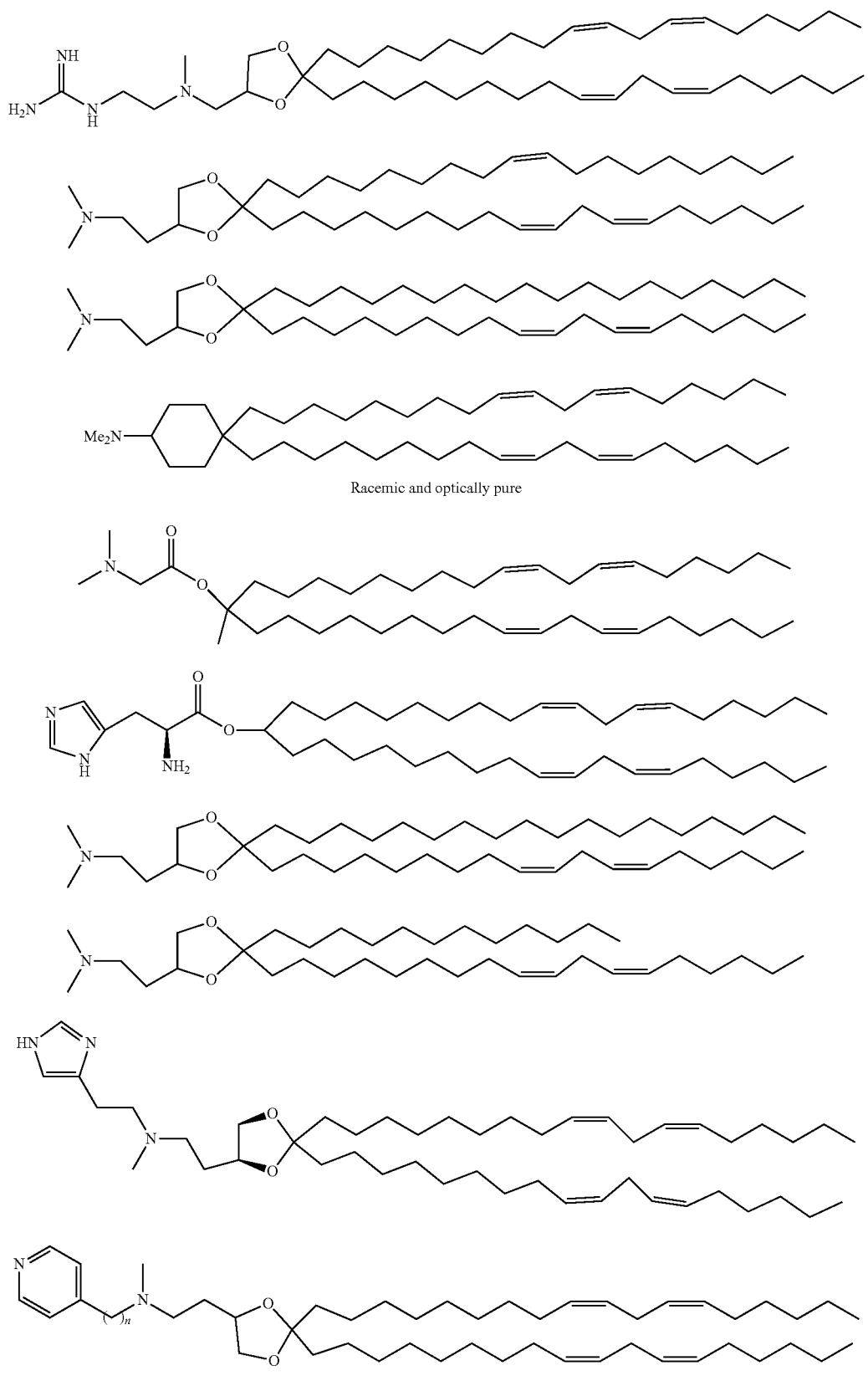
Racemic and optically pure
n = 0-6

TABLE 11-continued
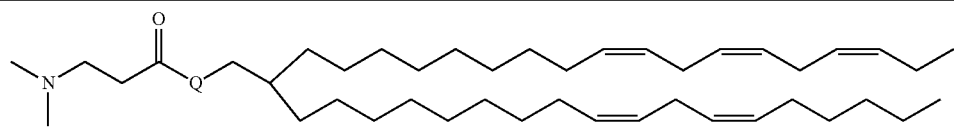
Q is O
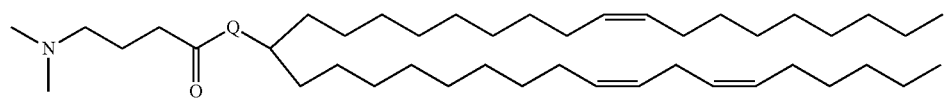
Q is O
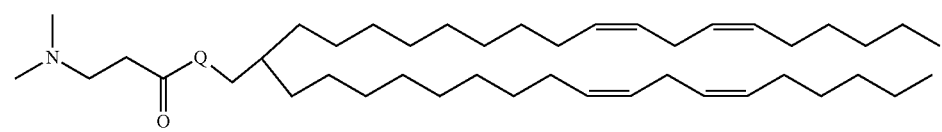
Q is O
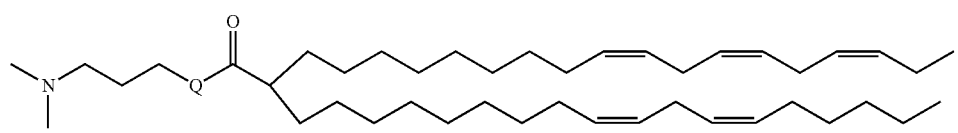
Q is O
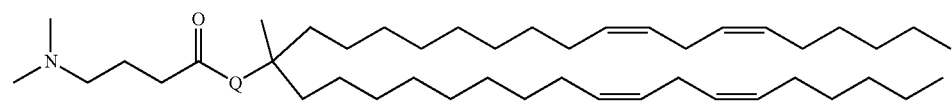
Q is O
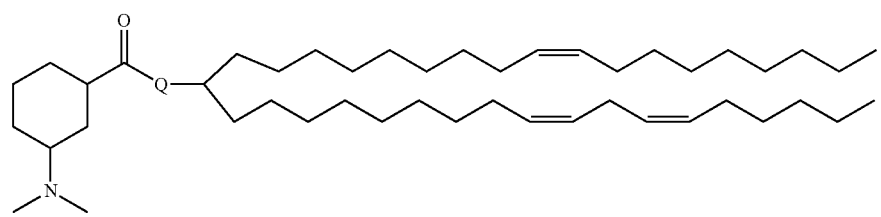
Q is O
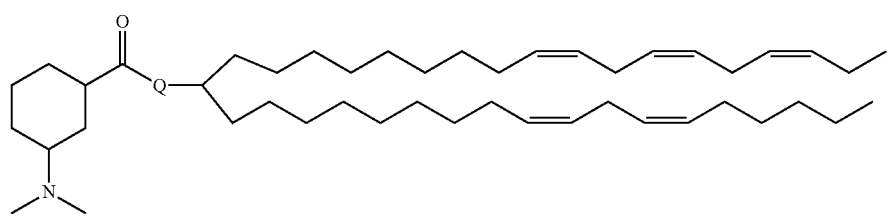
Q is O
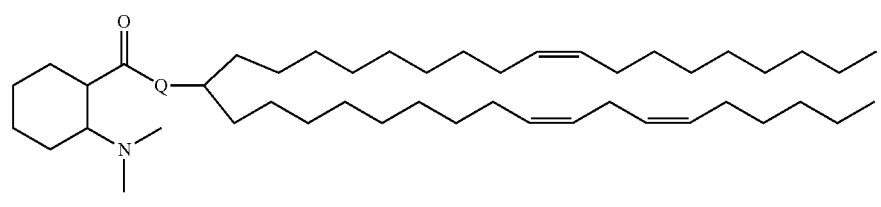
Q is O TABLE 11-continued
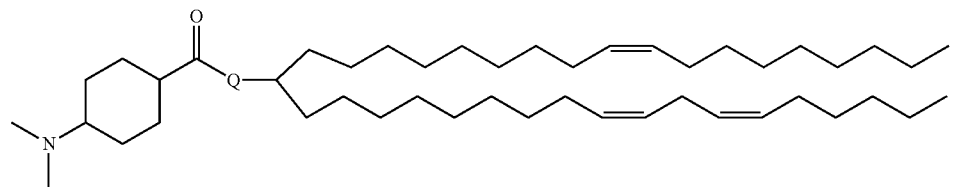
Q is O
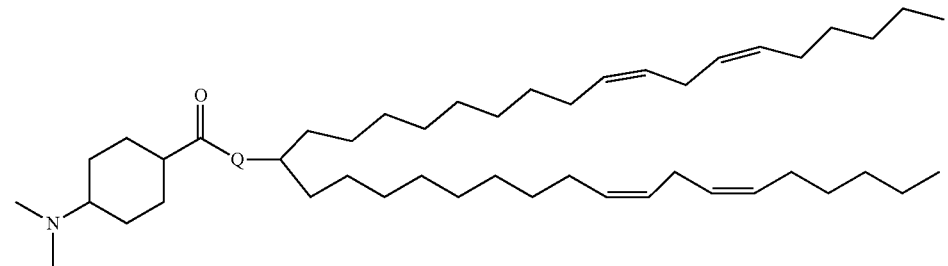
Q is O
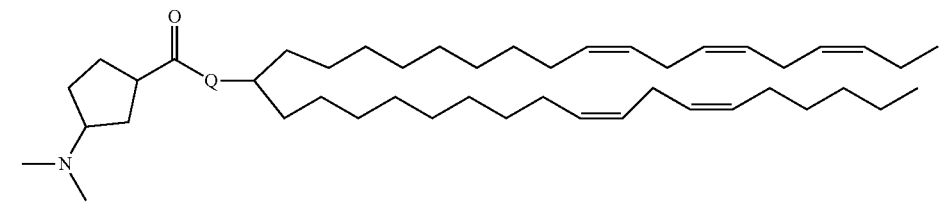
Q is O
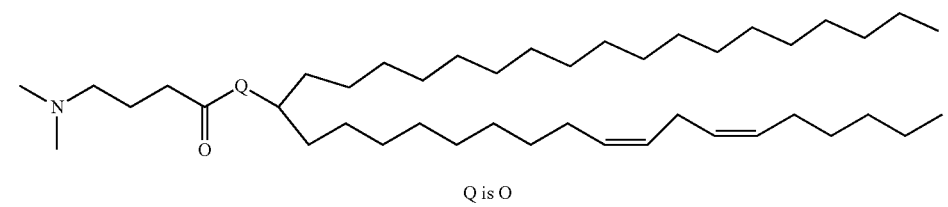
Q is O
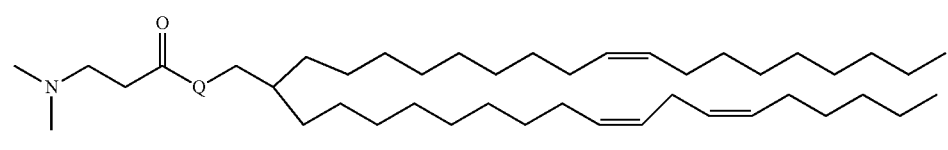
Q is O
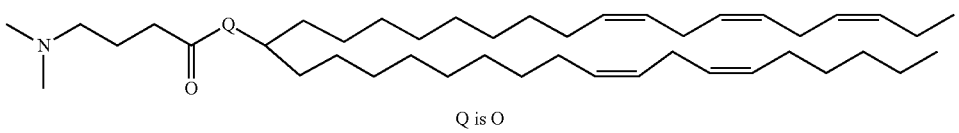
Q is O
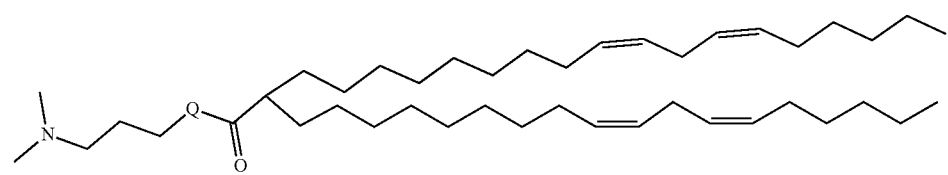
Q is O TABLE 11-continued
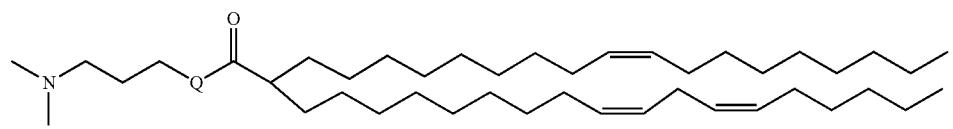
Q is O
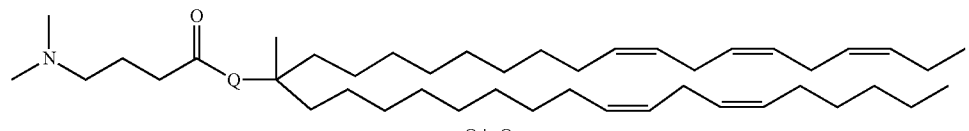
Q is O
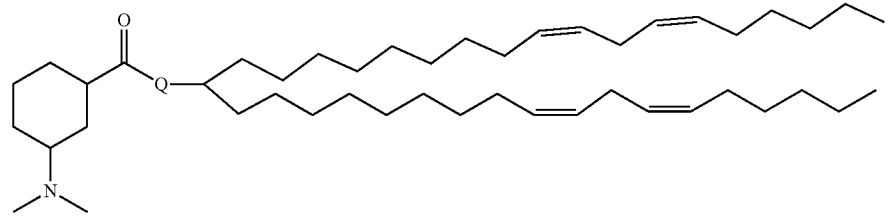
Q is O
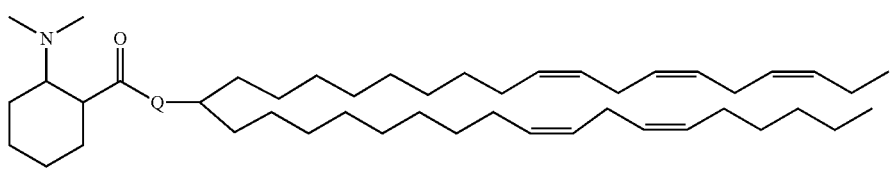
Q is O
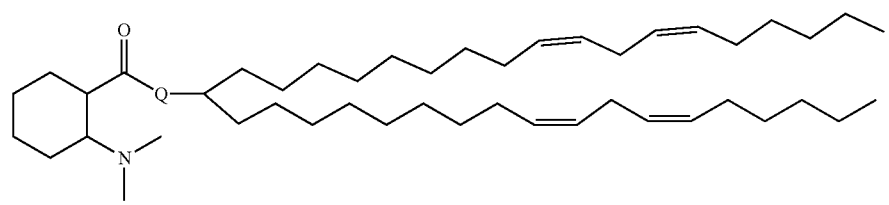
Q is O
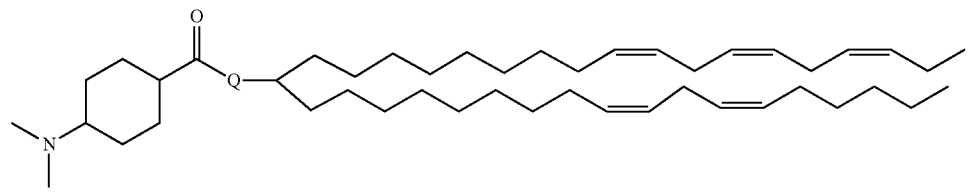
Q is O
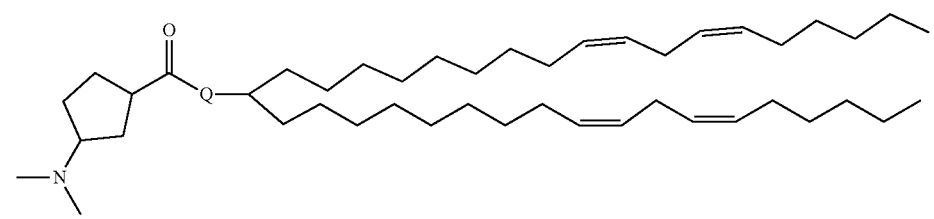
Q is O TABLE 11-continued
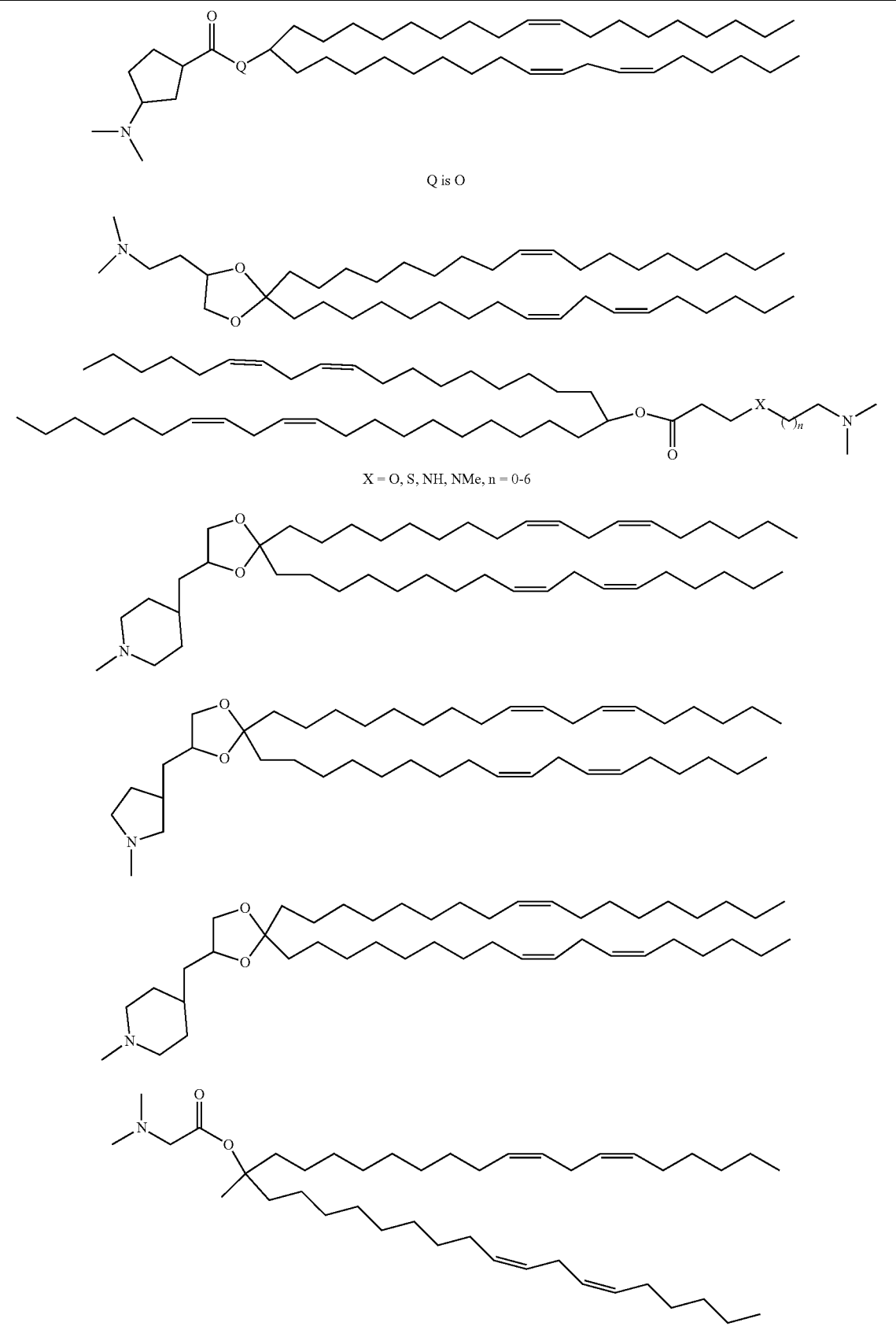
Q is O
X = O, S, NH, NMe, n = 0-6

TABLE 11-continued
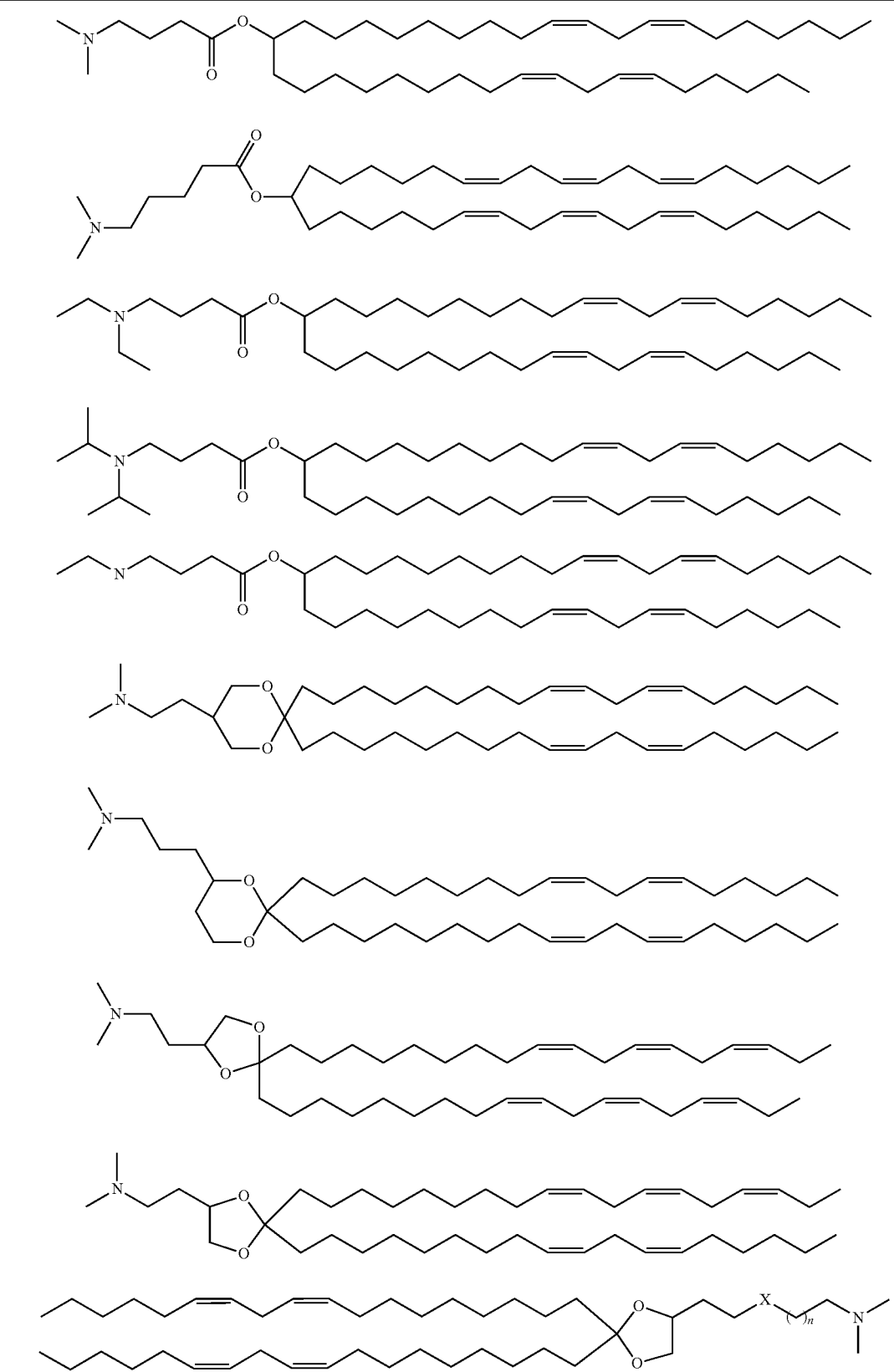
X = O, S, NH, NE; n = 0-6

TABLE 11-continued
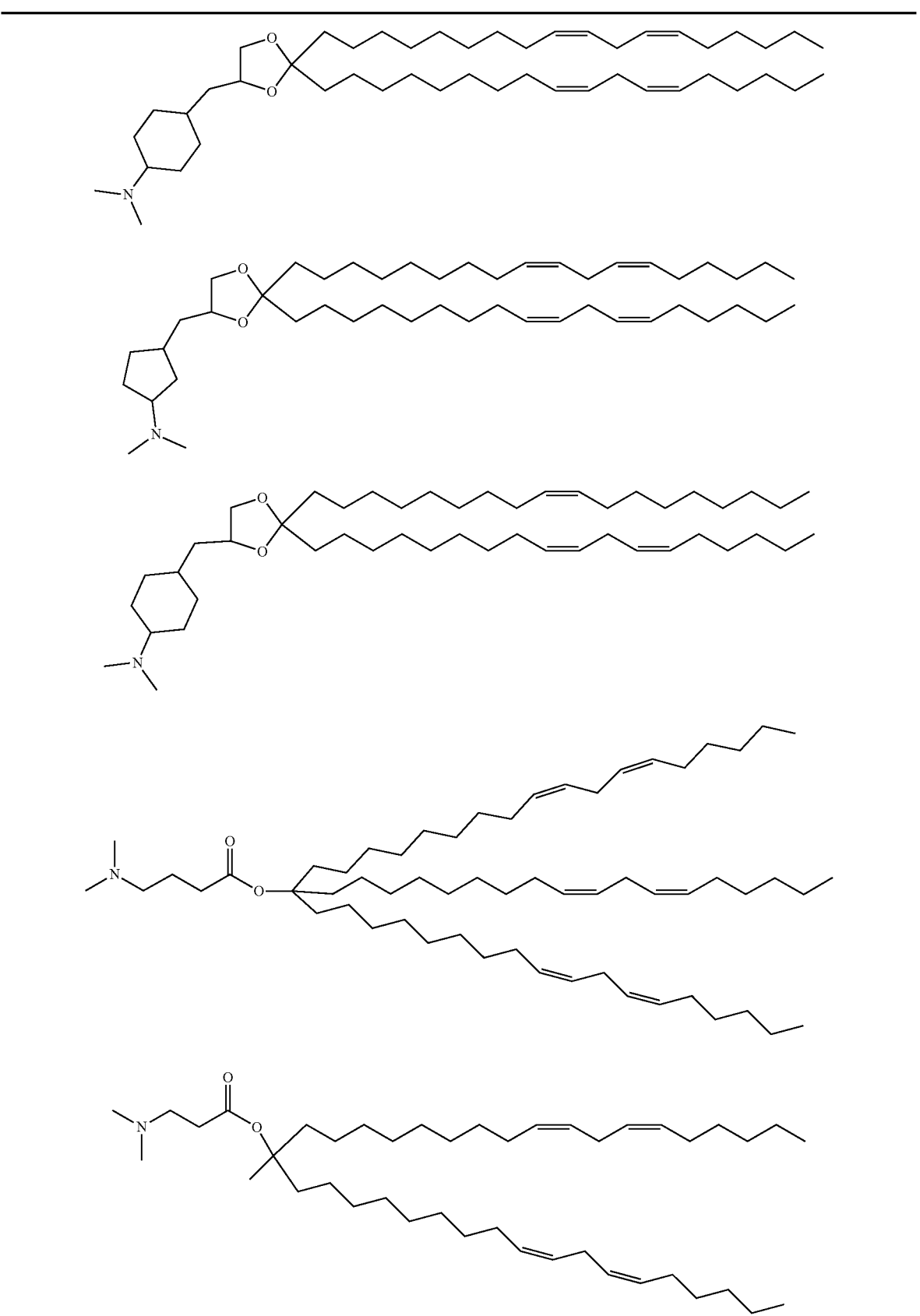

TABLE 11-continued
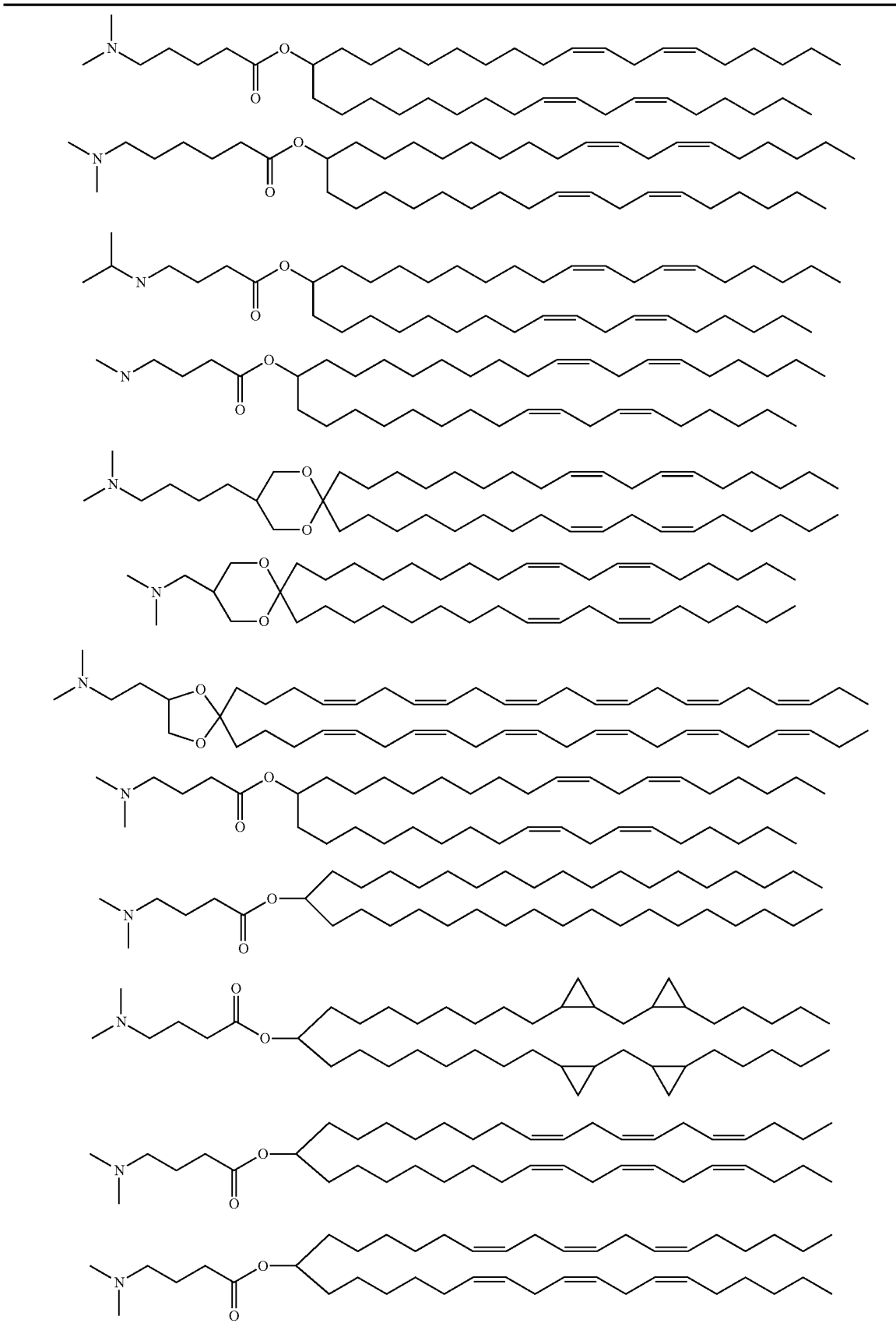

TABLE 11-continued
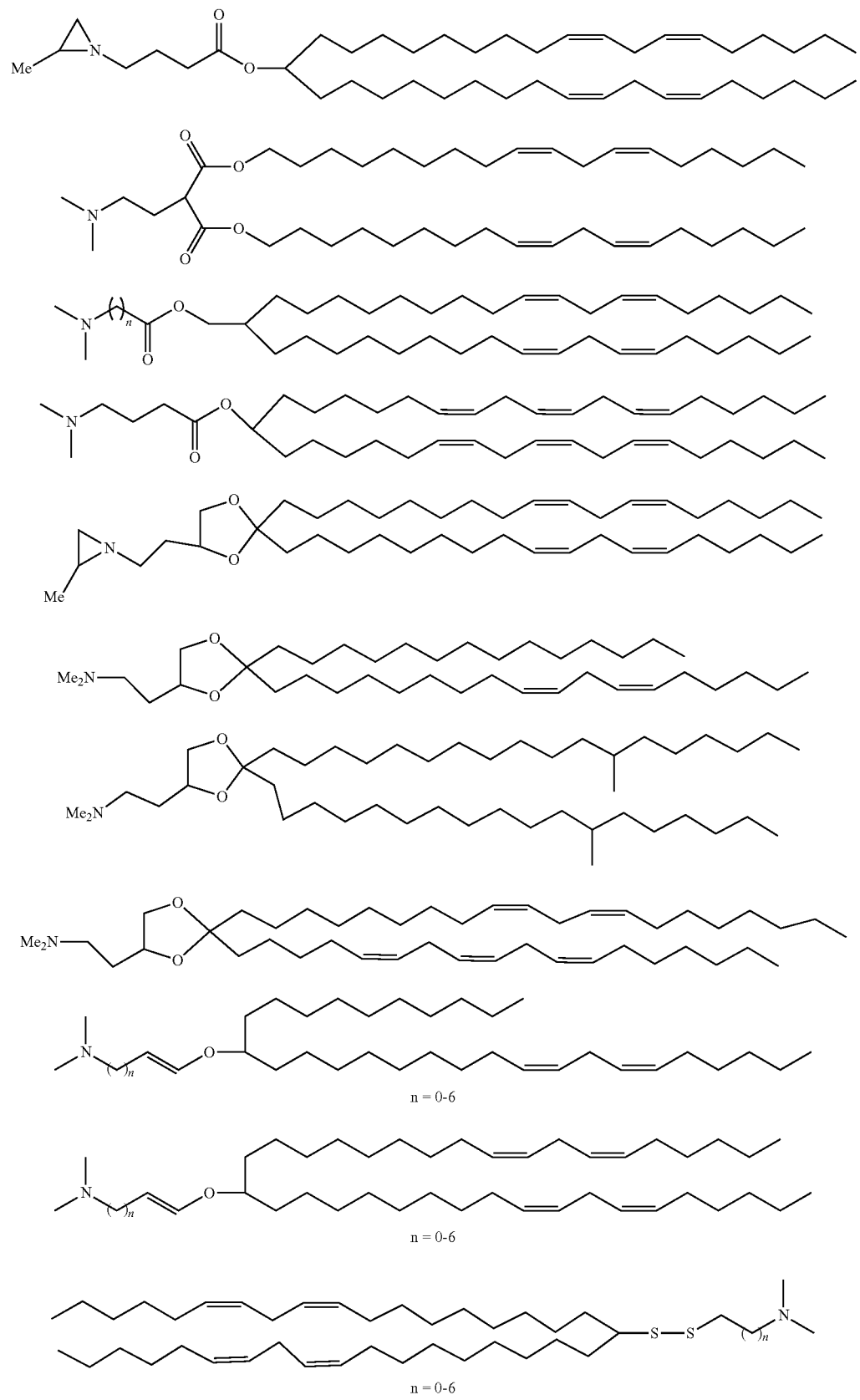

TABLE 11-continued
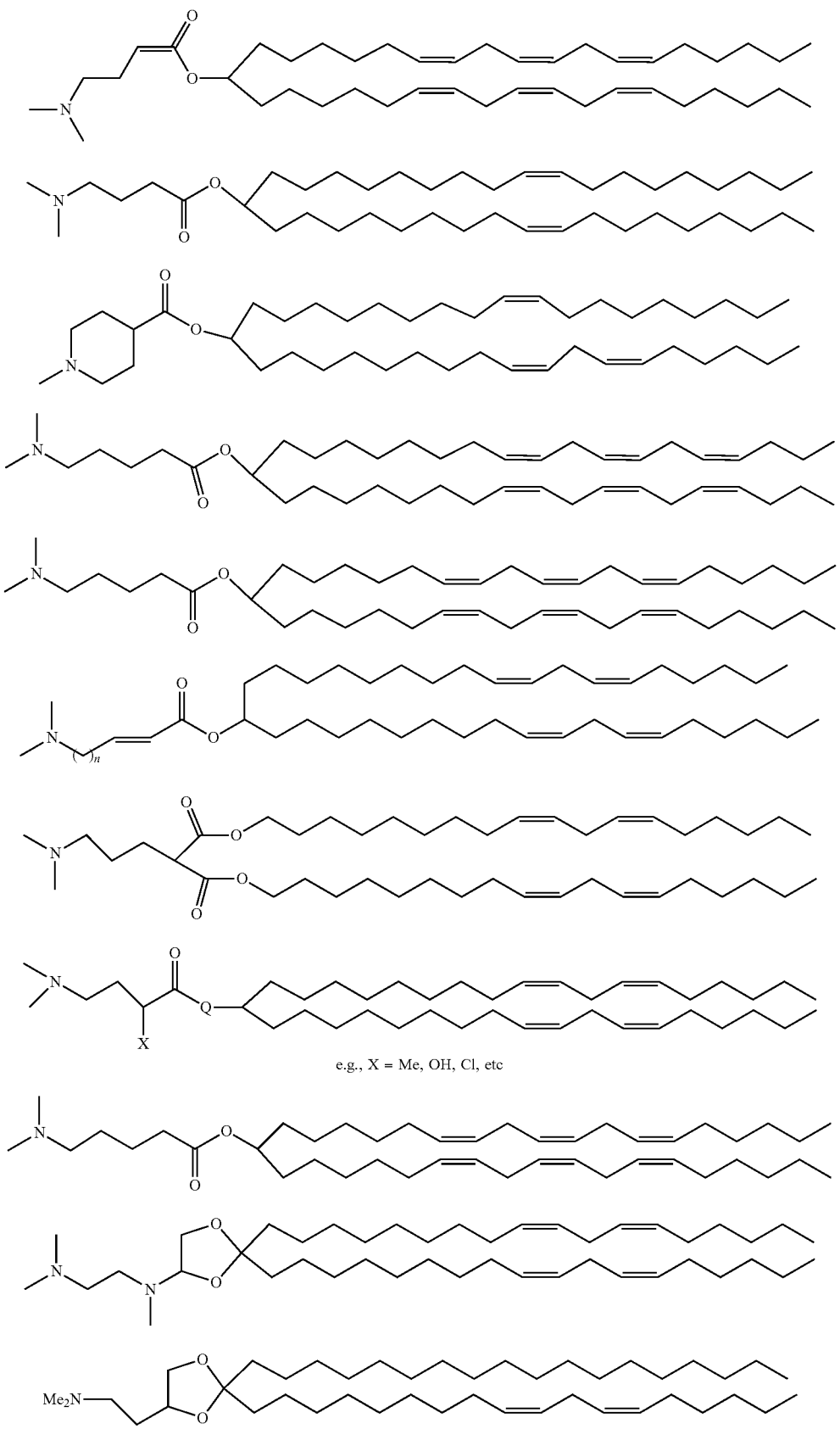
e.g., X = Me, OH, Cl, etc

TABLE 11-continued
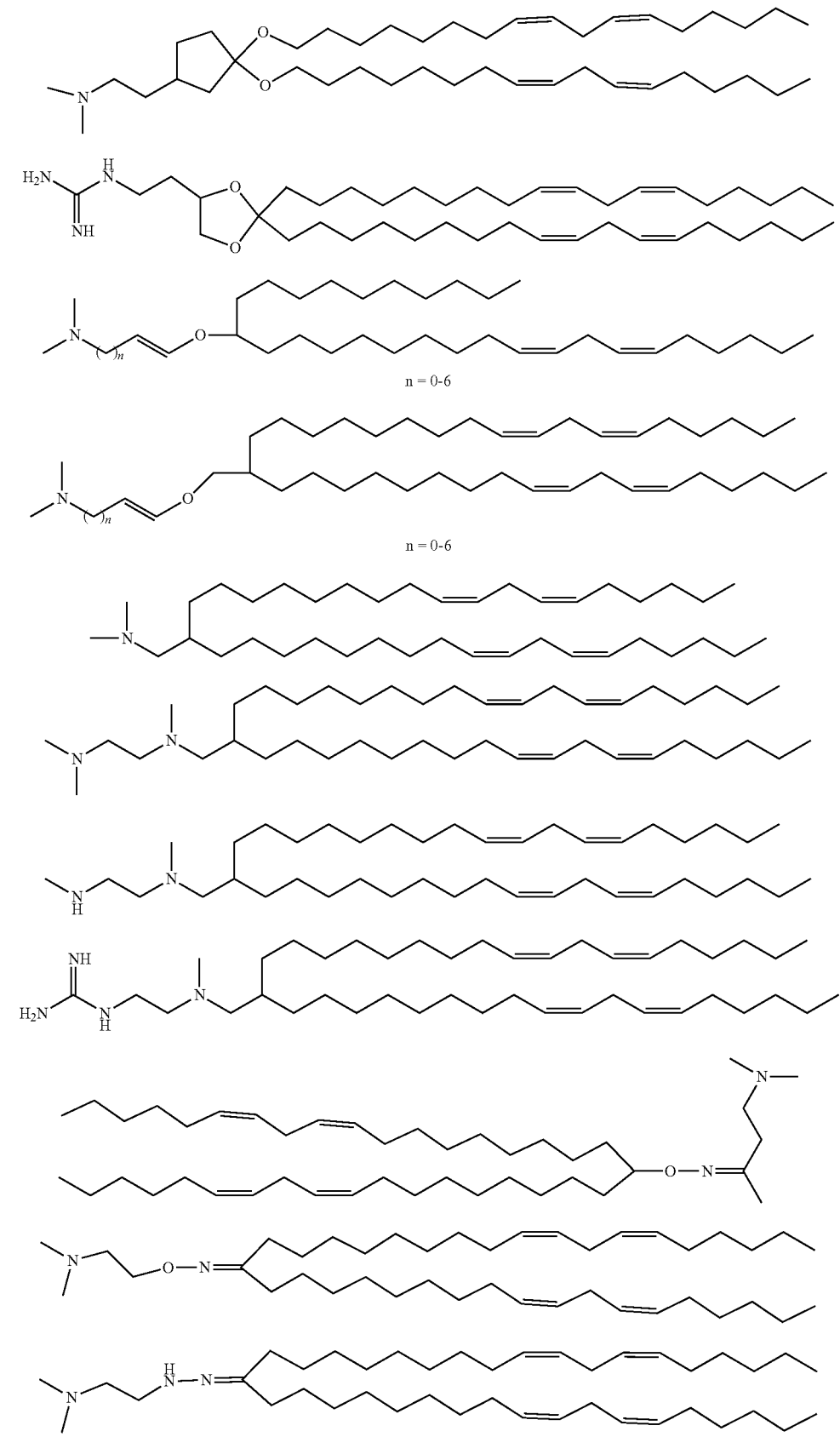

TABLE 11-continued
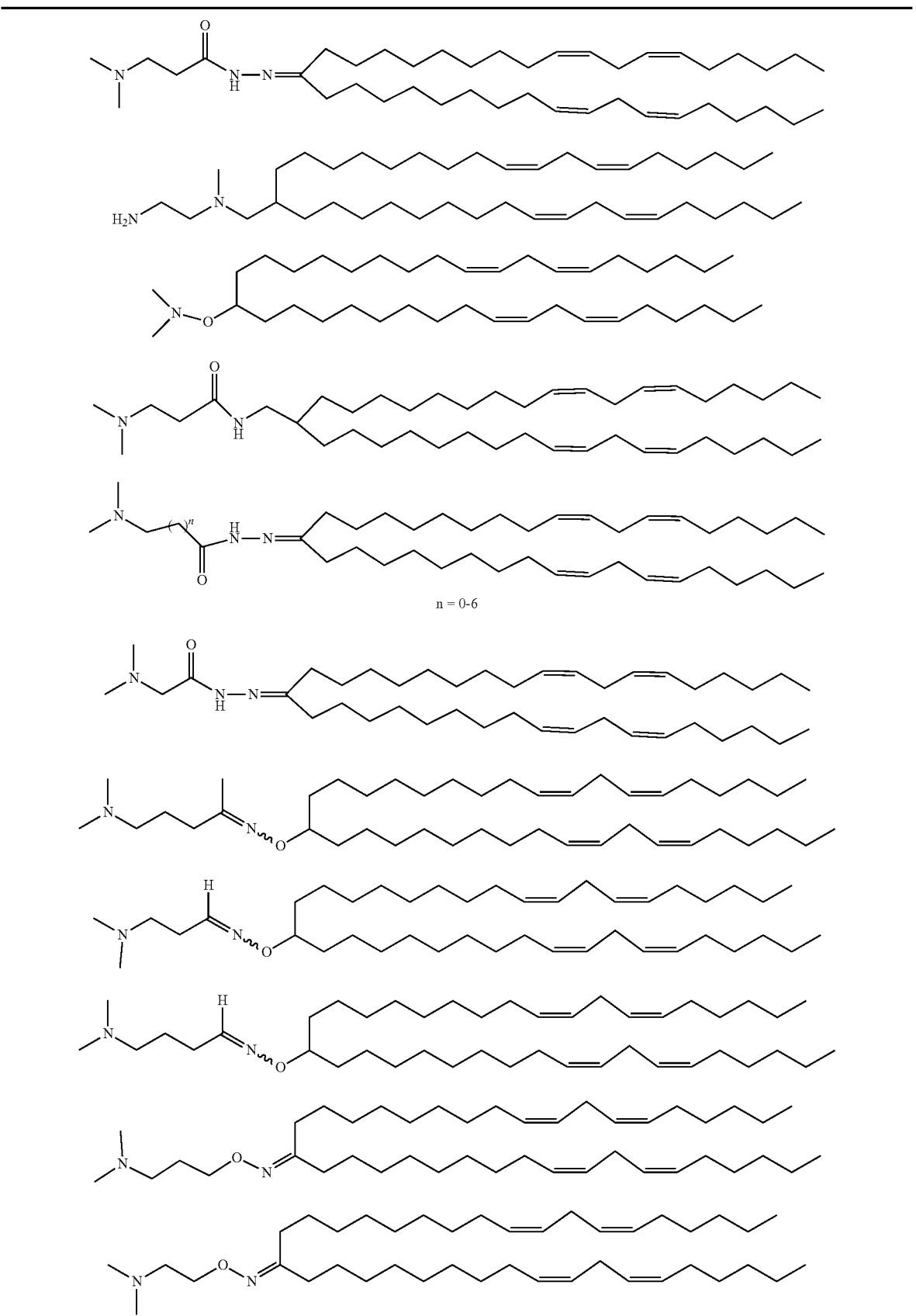

TABLE 11-continued
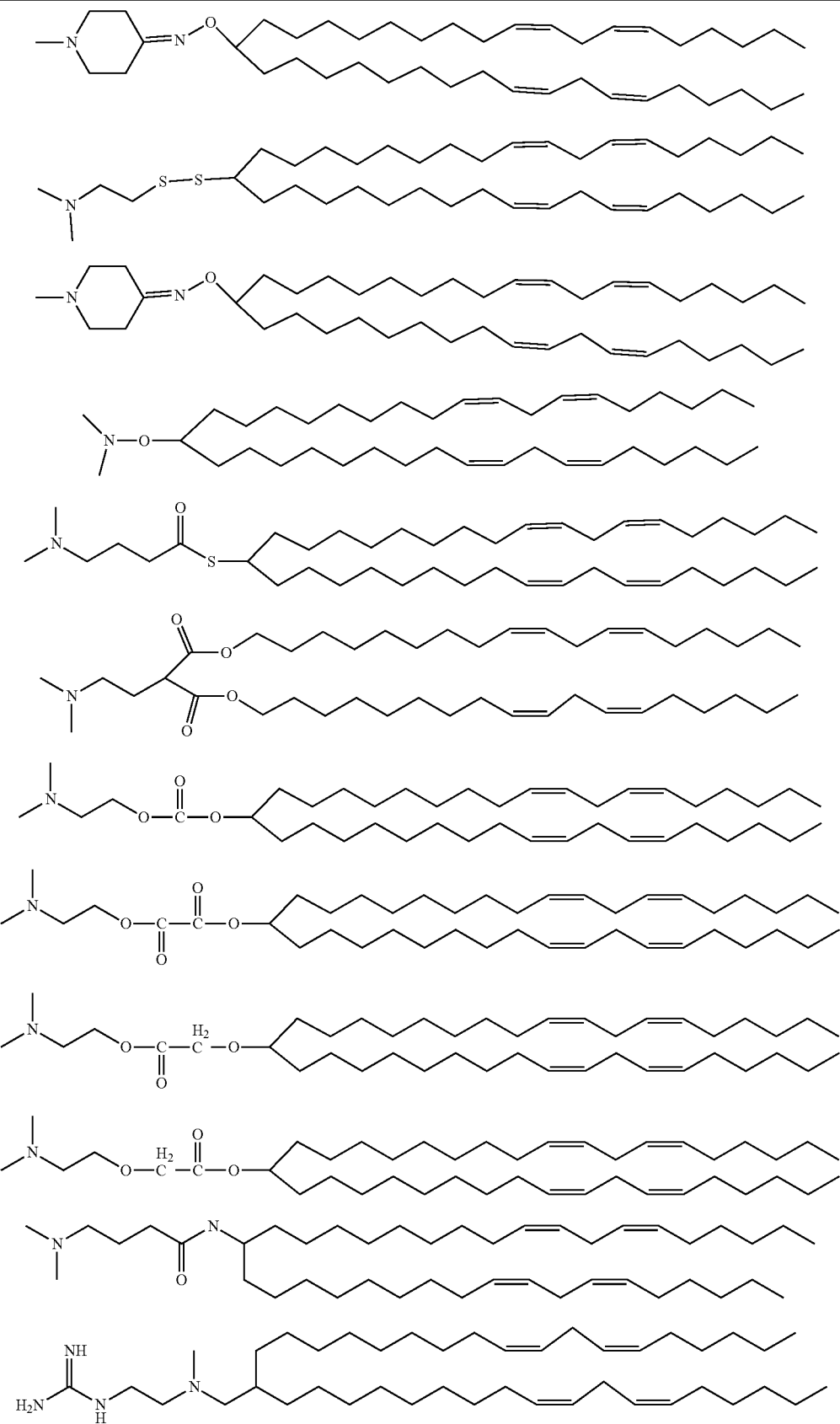

TABLE 11-continued
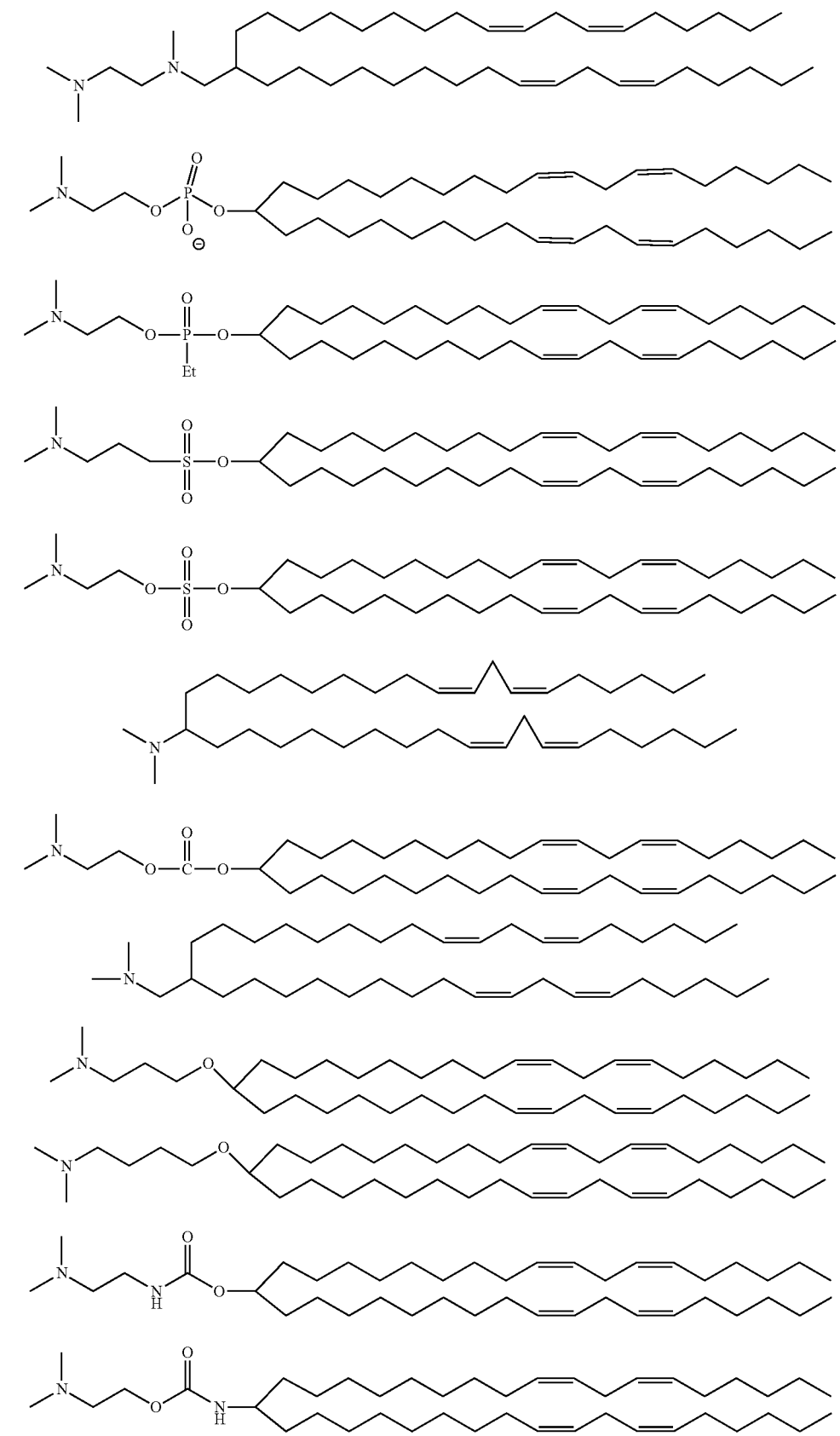

TABLE 11-continued
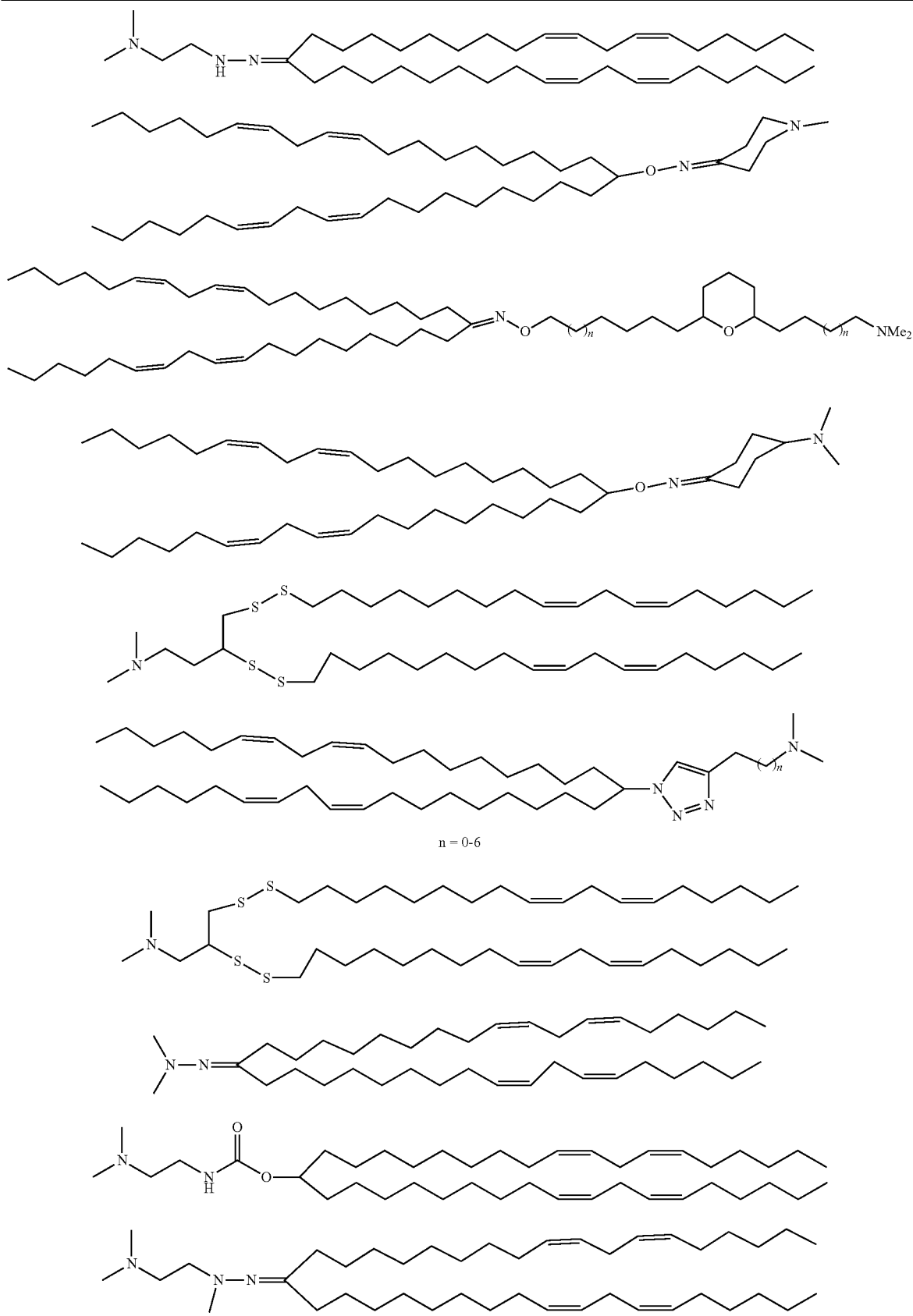

TABLE 11-continued
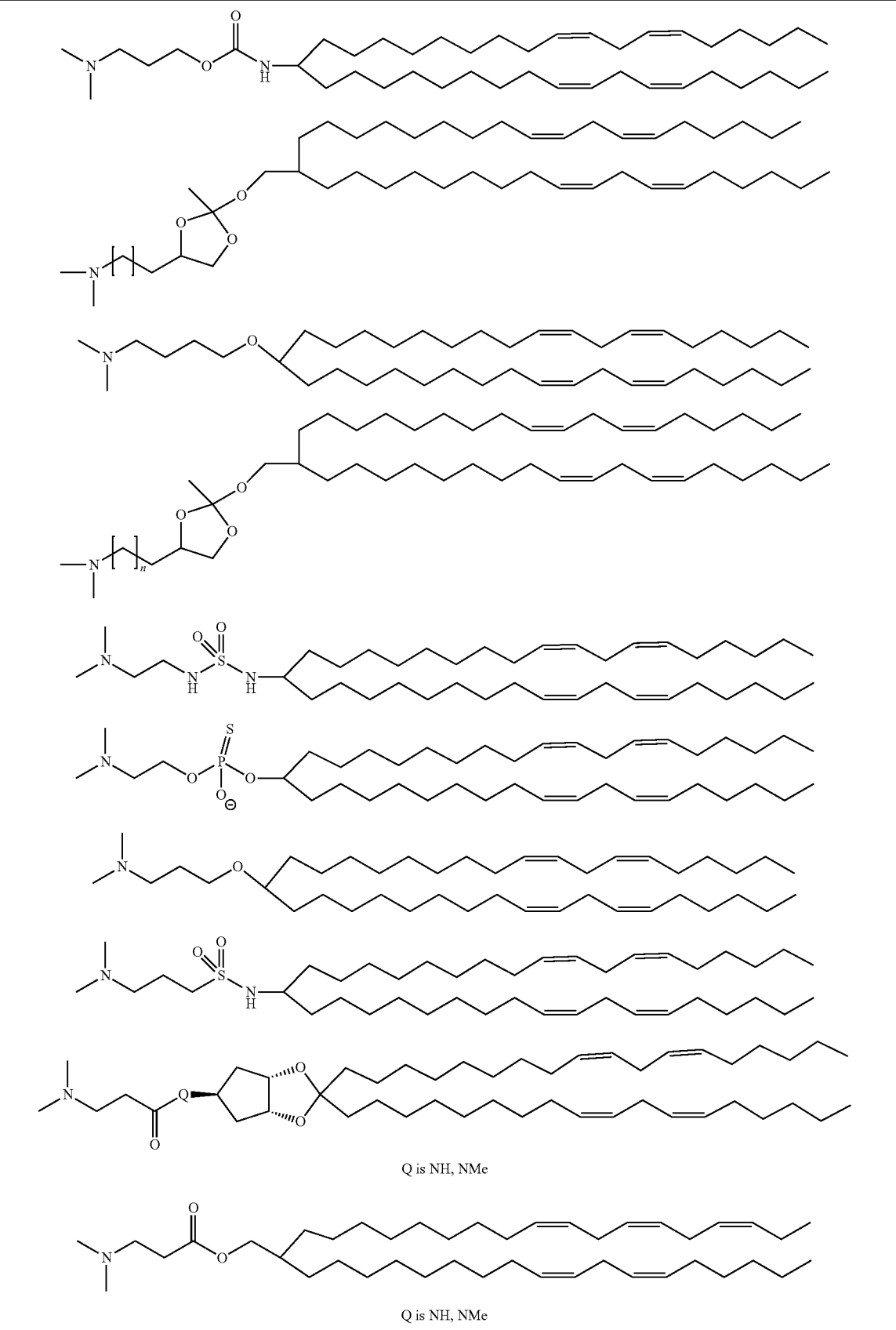
Q is NH, NMe
Q is NH, NMe

TABLE 11-continued
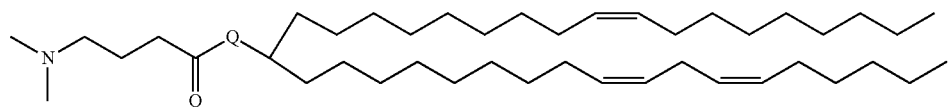
Q is NH, NMe
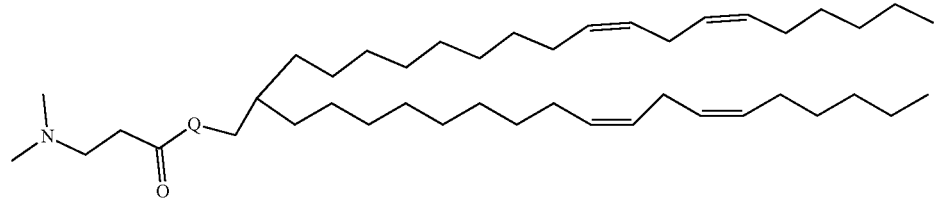
Q is NH, NMe
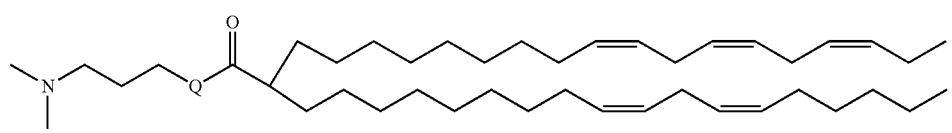
Q is NH, NMe
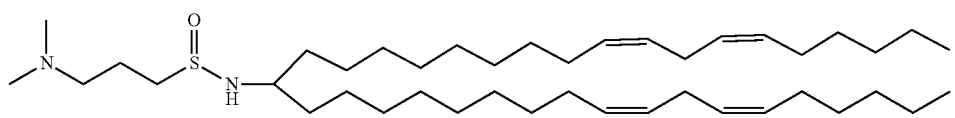 [SMILES: CCCCC/C=C\C/C=C\CCCCCCCCC(CCCCCCCC/C=C\C/C=C\CCCCC)NS(=O)CCCN(C)C]
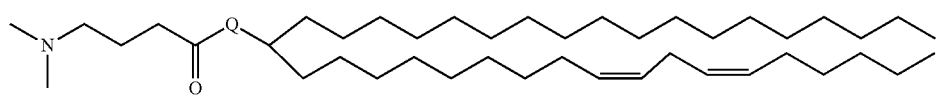
Q is NH, NMe
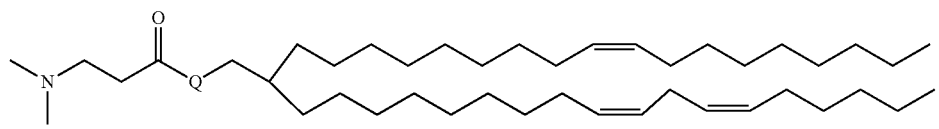
Q is NH, NMe
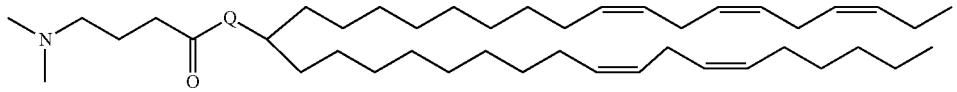
Q is NH, NMe
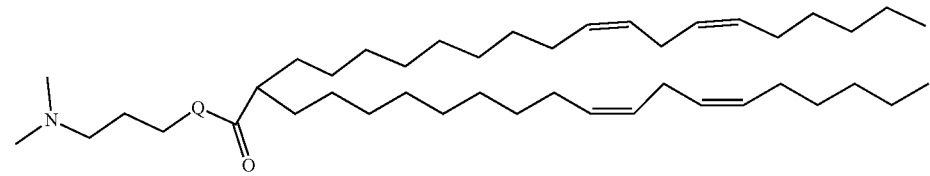
Q is NH, NMe
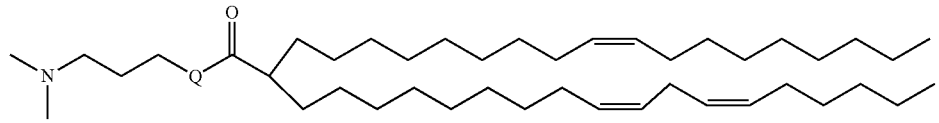
Q is NH, NMe TABLE 11-continued
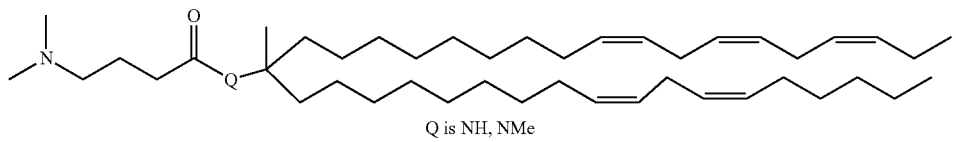
Q is NH, NMe
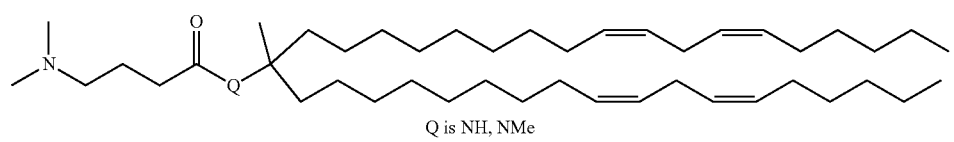
Q is NH, NMe
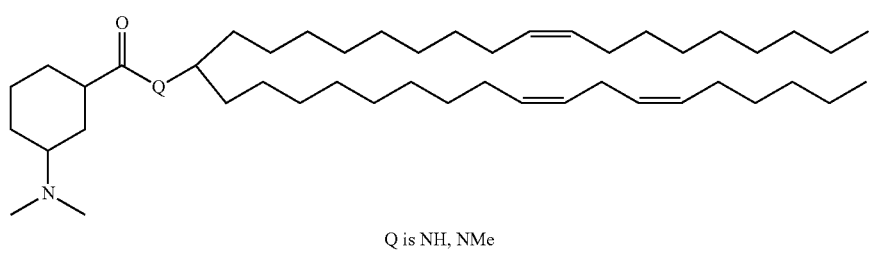
Q is NH, NMe
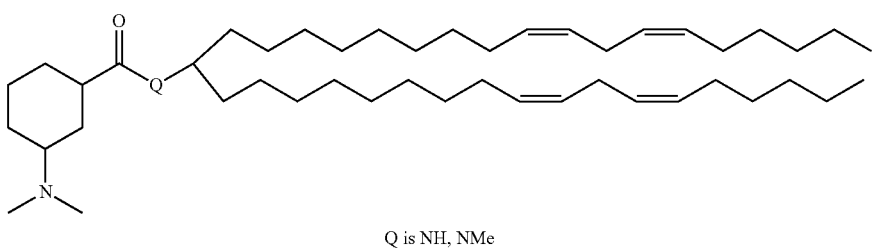
Q is NH, NMe
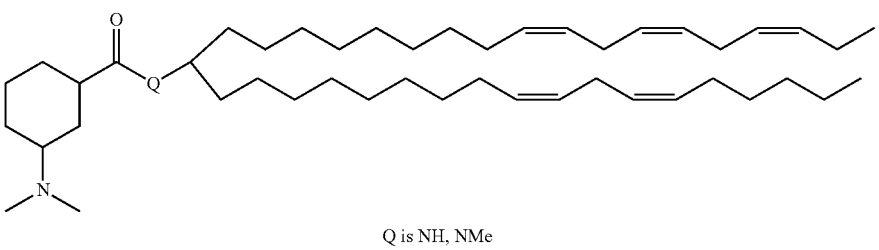
Q is NH, NMe
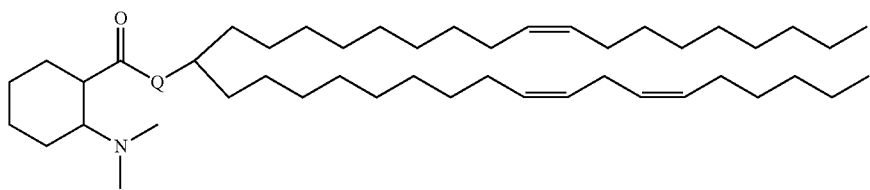
Q is NH, NMe
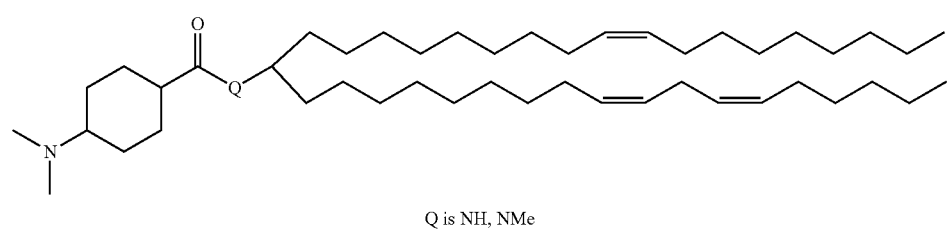
Q is NH, NMe TABLE 11-continued
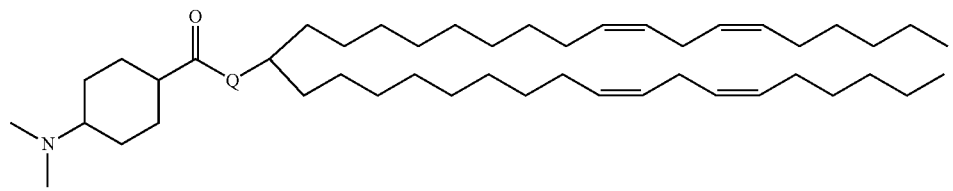
Q is NH, NMe
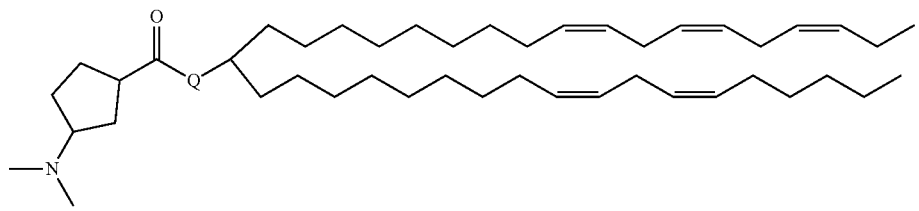
Q is NH, NMe
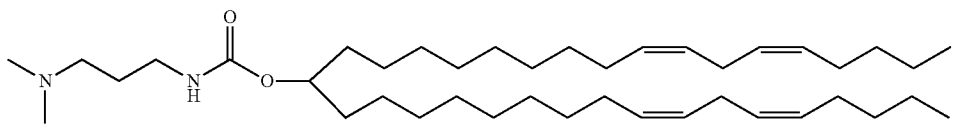 [SMILES: CCCC/C=C\C/C=C\CCCCCCCCC(CCCCCCCC/C=C\C/C=C\CCCC)OC(=O)NCCCN(C)C]
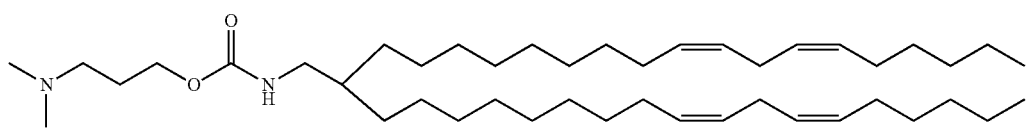 [SMILES: CCCCC/C=C\C/C=C\CCCCCCCCC(CCCCCCCC/C=C\C/C=C\CCCCC)CNC(=O)OCCCN(C)C]
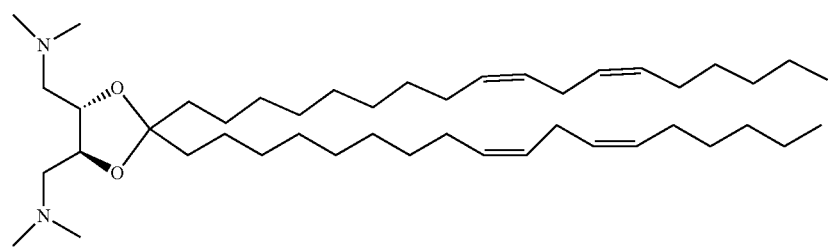 [SMILES: CCCCC/C=C\C/C=C\CCCCCCCCC1(CCCCCCCC/C=C\C/C=C\CCCCC)O[C@@H](CN(C)C)[C@H](CN(C)C)O1]
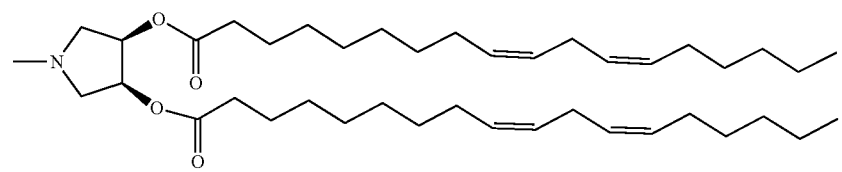 [SMILES: CCCCC/C=C\C/C=C\CCCCCCCC(=O)O[C@H]1CN(C)C[C@H]1OC(=O)CCCCCCC/C=C\C/C=C\CCCCC]
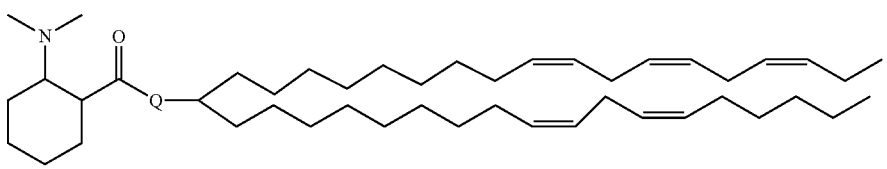
Q is NH, NMe
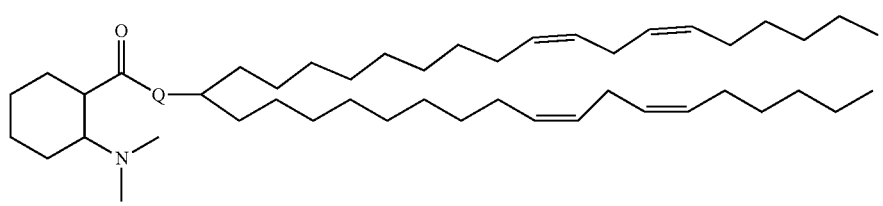
Q is NH, NMe TABLE 11-continued
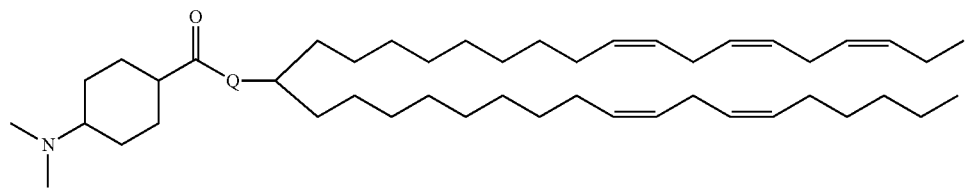
Q is NH, NMe
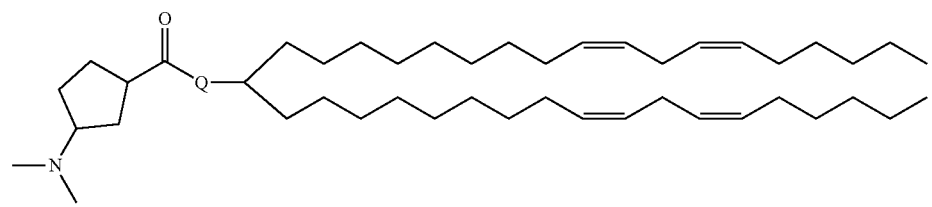
Q is NH, NMe
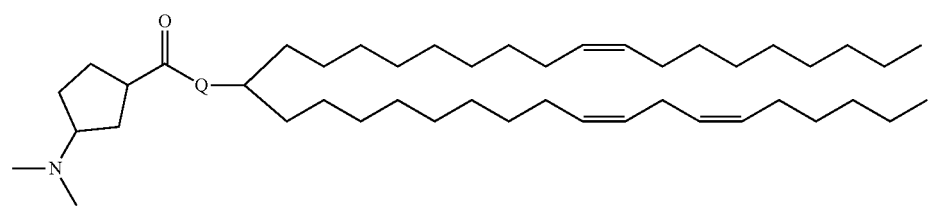
Q is NH, NMe
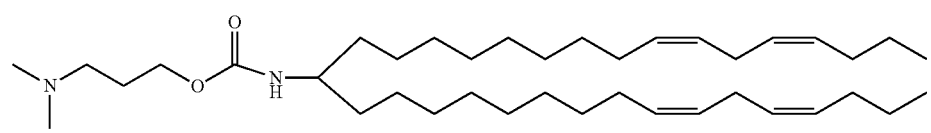 [SMILES: CCC/C=C\C/C=C\CCCCCCCCC(CCCCCCCC/C=C\C/C=C\CCC)NC(=O)OCCCN(C)C]
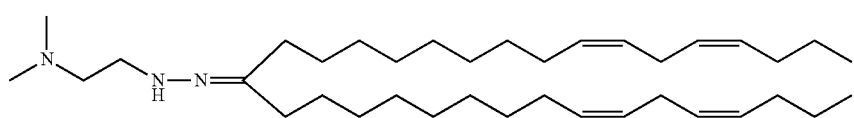 [SMILES: CCC/C=C\C/C=C\CCCCCCCCC(CCCCCCCC/C=C\C/C=C\CCC)=NNCCN(C)C]
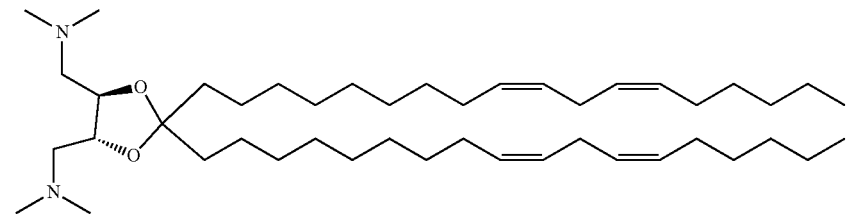 [SMILES: CCCCC/C=C\C/C=C\CCCCCCCCC1(CCCCCCCC/C=C\C/C=C\CCCCC)O[C@H](CN(C)C)[C@@H](CN(C)C)O1]
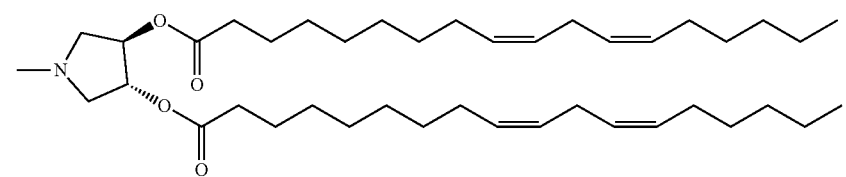 [SMILES: CCCCC/C=C\C/C=C\CCCCCCCC(=O)O[C@@H]1CN(C)C[C@H]1OC(=O)CCCCCCC/C=C\C/C=C\CCCCC]
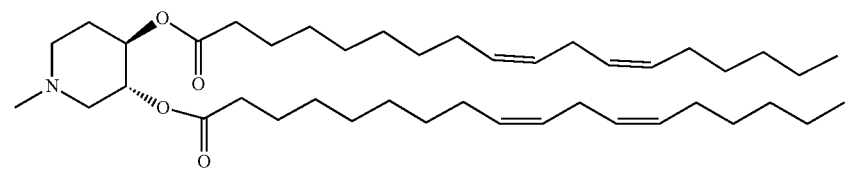 [SMILES: CCCCC/C=C\C/C=C\CCCCCCCC(=O)O[C@@H]1CCN(C)C[C@H]1OC(=O)CCCCCCC/C=C\C/C=C\CCCCC]

TABLE 11-continued
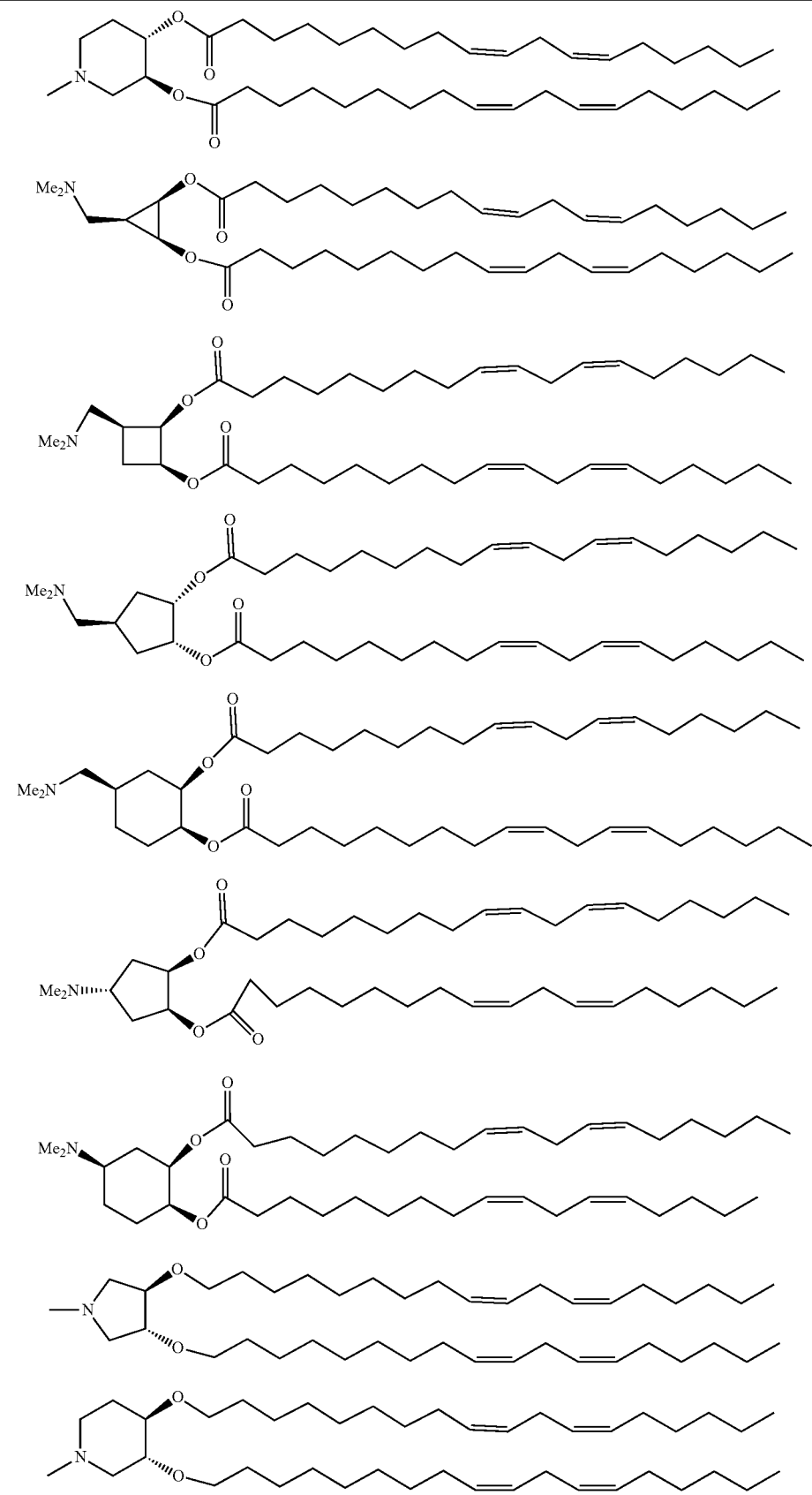

TABLE 11-continued
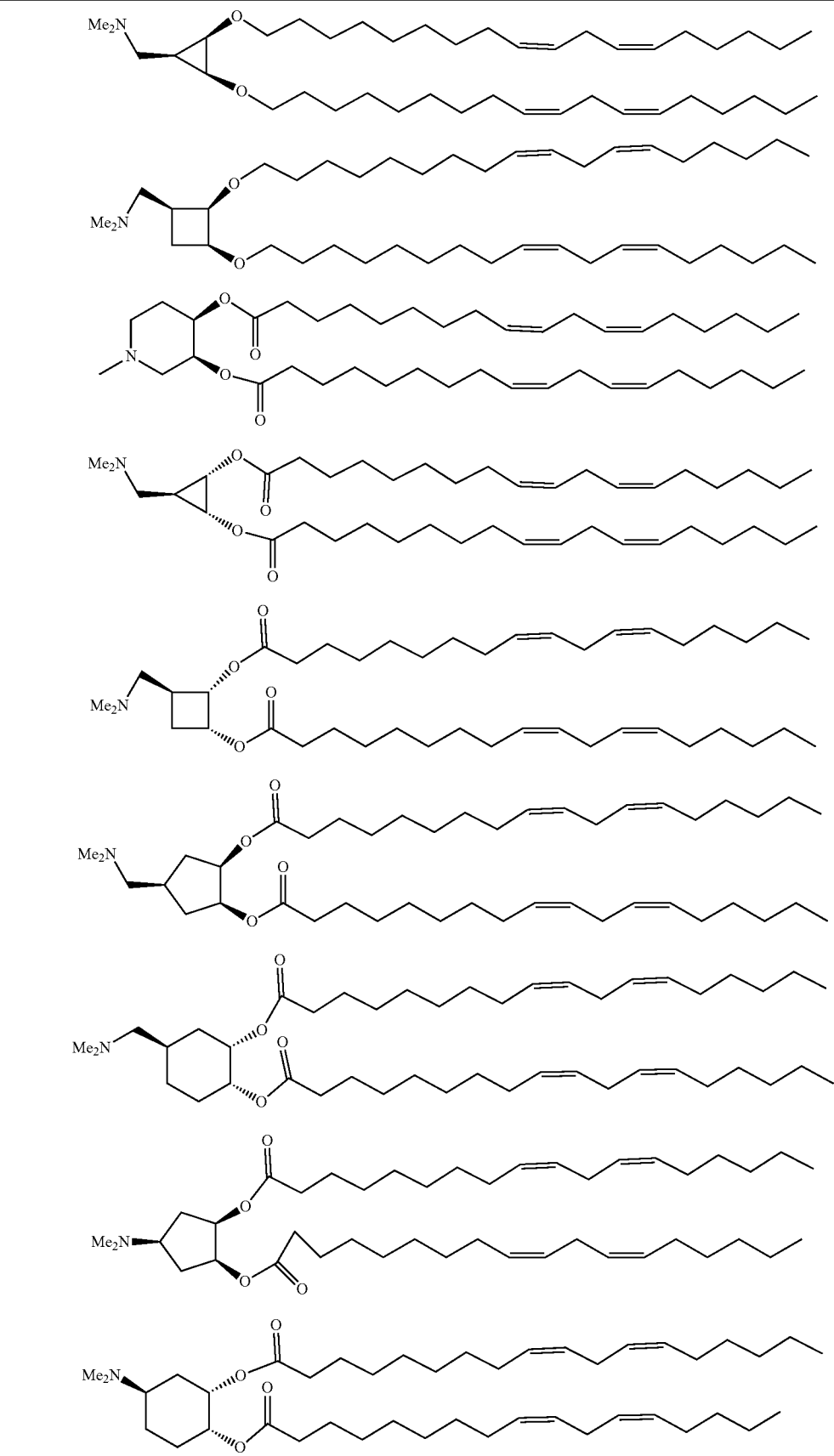

TABLE 11-continued
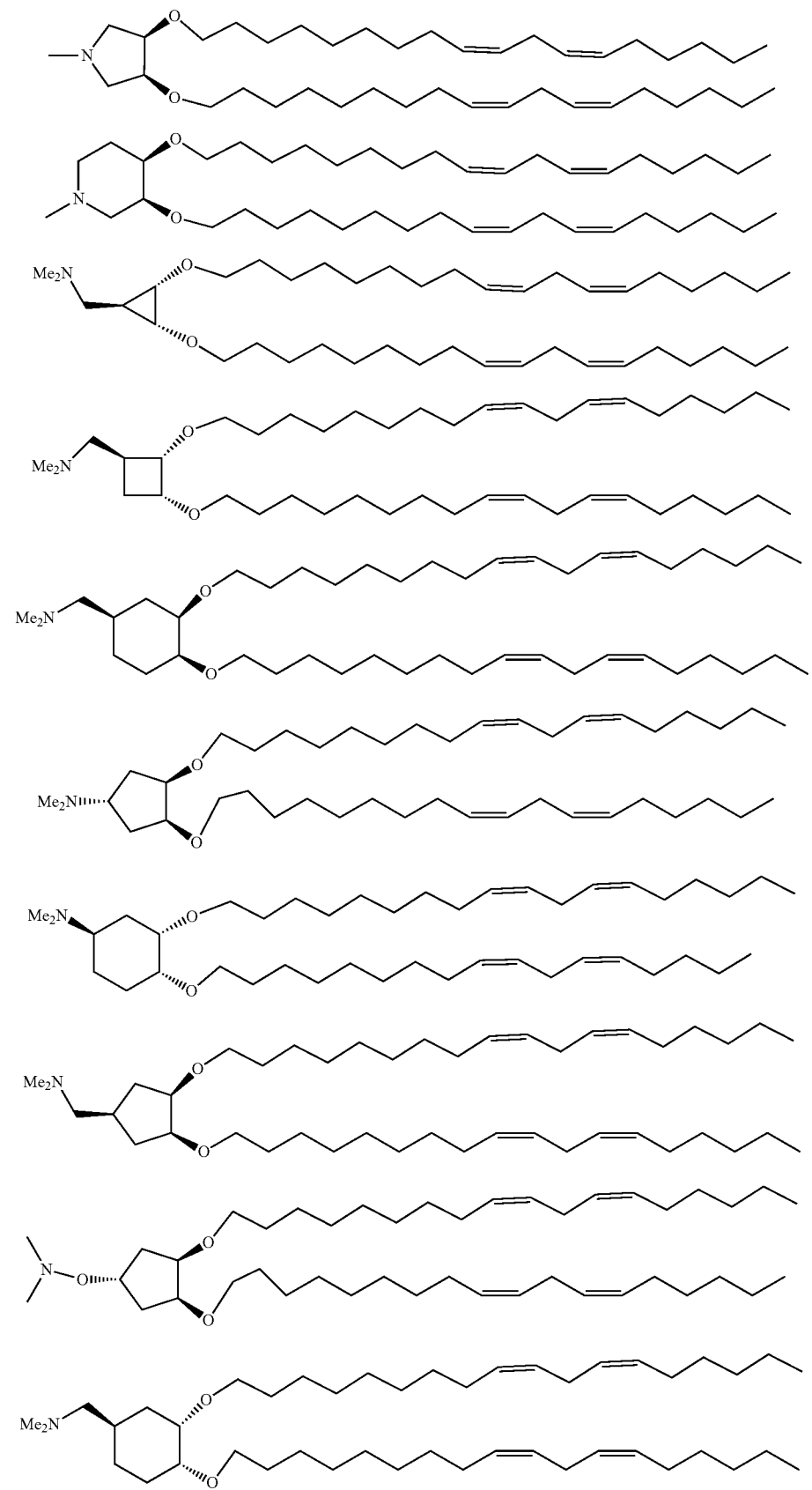

TABLE 11-continued

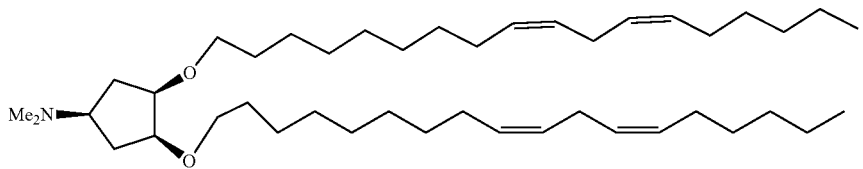 [SMILES: CCCCC/C=C\C/C=C\CCCCCCCCO[C@H]1C[C@@H](N(C)C)C[C@H]1OCCCCCCCC/C=C\C/C=C\CCCCC]

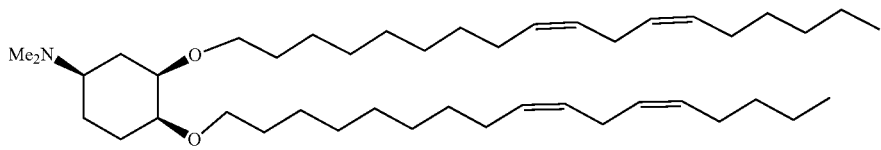 [SMILES: CCCC/C=C\C/C=C\CCCCCCCCO[C@H]1CC[C@@H](N(C)C)C[C@H]1OCCCCCCCC/C=C\C/C=C\CCCCC]

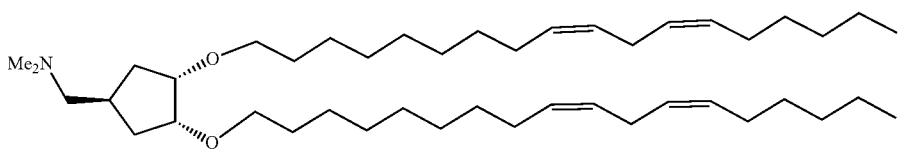 [SMILES: CCCCC/C=C\C/C=C\CCCCCCCCO[C@H]1C[C@H](CN(C)C)C[C@H]1OCCCCCCCC/C=C\C/C=C\CCCCC]

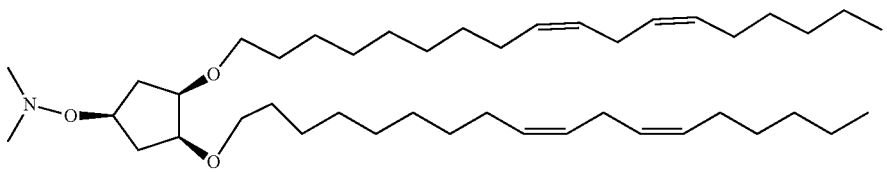 [SMILES: CCCCC/C=C\C/C=C\CCCCCCCCO[C@H]1C[C@@H](ON(C)C)C[C@H]1OCCCCCCCC/C=C\C/C=C\CCCCC]

In some embodiments, the transfer vehicle comprises Lipid A, Lipid B, Lipid C, and/or Lipid D. In some embodiments, inclusion of Lipid A, Lipid B, Lipid C, and/or Lipid D improves encapsulation and/or endosomal escape. In some embodiments, Lipid A, Lipid B, Lipid C, and/or Lipid D are described in international patent application PCT/US2017/028981.

In some embodiments, an ionizable lipid is Lipid A, which is (9Z,12Z)-3-((4,4-bis(octyloxy)butanoyl)oxy)-2-((((3-(diethylamino)propoxy)carbonyl)oxy)methyl)propyl octadeca9,12-dienoate, also called 3-((4,44bis(octyloxy)butanoyl)oxy)-2-((((3-(diethylamino)propoxy)carbonyl)oxy)methyl)propyl (9Z,12Z)-octadeca-9,12-dienoate. Lipid A can be depicted as:

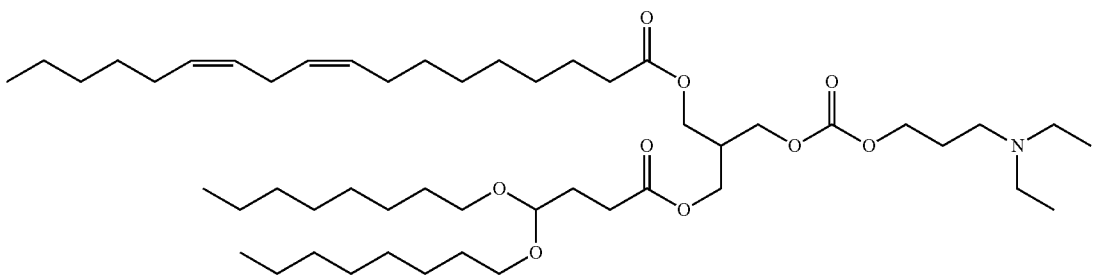 [SMILES: CCCCC/C=C\C/C=C\CCCCCCCC(=O)OCC(COC(=O)CCC(OCCCCCCCC)OCCCCCCCC)COC(=O)OCCCN(CC)CC]

Lipid A may be synthesized according to WO2015/095340 (e.g., pp. 84-86), incorporated by reference in its entirety.

In some embodiments, an ionizable lipid is Lipid B, which is ((5-((dimethylamino)methyl)-1,3-phenylene)bis(oxy))bis(octane-8,1-diyl)bis(decanoate). Lipid B can be depicted as:

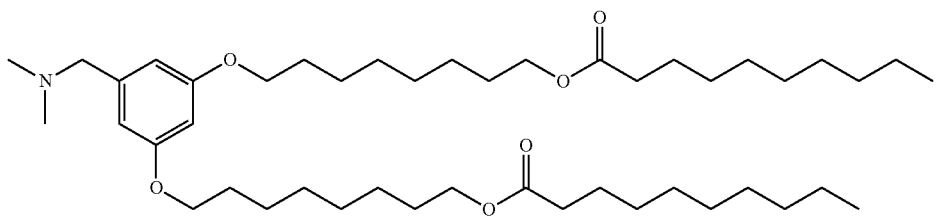 [SMILES: CCCCCCCCCC(=O)OCCCCCCCCOc1cc(CN(C)C)cc(OCCCCCCCCOC(=O)CCCCCCCCC)c1]

Lipid B may be synthesized according to WO2014/136086 (e.g., pp. 107-09), incorporated by reference in its entirety.

In some embodiments, an ionizable lipid is Lipid C, which is 2-((4-(((3-(dimethylamino)propoxy)carbonyl)oxy)hexadecanoyl)oxy)propane-1,3-diyl(9Z,9'Z,12Z,12'Z)-bis(octadeca-9,12-dienoate). Lipid C can be depicted as:

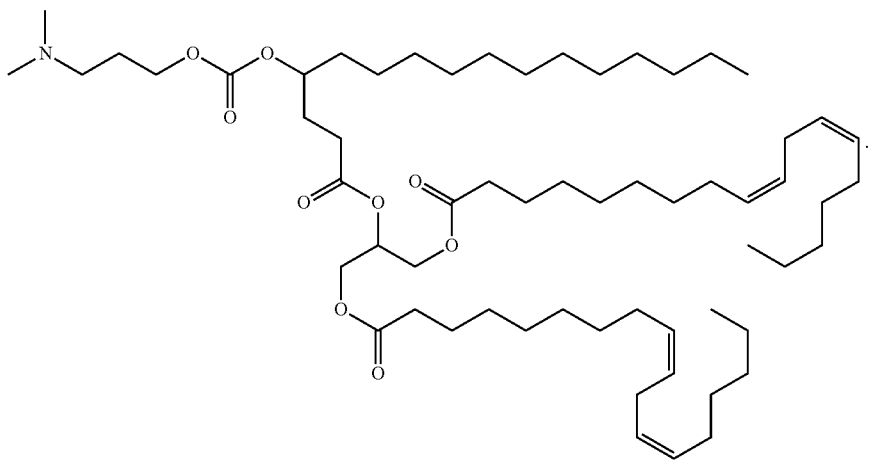 [SMILES: CCCCC/C=C\C/C=C\CCCCCCCC(=O)OCC(COC(=O)CCCCCCC/C=C\C/C=C\CCCCC)OC(=O)CCC(CCCCCCCCCCCC)OC(=O)OCCCN(C)C]

In some embodiments, an ionizable lipid is Lipid D, which is 3-(((3-(dimethylamino)propoxy)carbonyl)oxy)-13-(octanoyloxy)tridecyl 3-octylundecanoate. Lipid D can be depicted as:

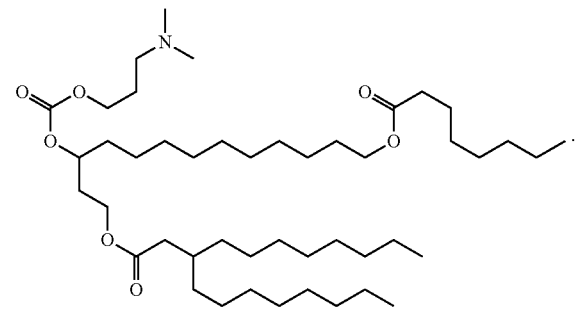 [SMILES: CCCCCCCCC(CCCCCCCC)CC(=O)OCCC(CCCCCCCCCCOC(=O)CCCCCCC)OC(=O)OCCCN(C)C]

Lipid C and Lipid D may be synthesized according to WO2015/095340, incorporated by reference in its entirety.

In some embodiments, an ionizable lipid is described in US patent publication number 20190321489. In some embodiments, an ionizable lipid is described in international patent publication WO 2010/053572, incorporated herein by reference. In some embodiments, an ionizable lipid is $C_{12}$-200, described at paragraph [00225] of WO 2010/053572.

Several ionizable lipids have been described in the literature, many of which are commercially available. In certain embodiments, such ionizable lipids are included in the transfer vehicles described herein. In some embodiments, the ionizable lipid N-[1-(2,3-dioleyloxy)propyl]-N,N,N-trimethylammonium chloride or "DOTMA" is used. (Felgner et al. Proc. Nat'l Acad. Sci. 84, 7413 (1987); U.S. Pat. No. 4,897,355). DOTMA can be formulated alone or can be combined with a neutral lipid, dioleoylphosphatidylethanolamine or "DOPE" or other cationic or non-cationic lipids into a lipid nanoparticle. Other suitable cationic lipids include, for example, ionizable cationic lipids as described in U.S. provisional patent application 61/617,468, filed Mar. 29, 2012 (incorporated herein by reference), such as, e.g., (15Z,18Z)—N,N-dimethyl-6-(9Z,12Z)-octadeca-9,12-dien-1-yl)tetracosa-15,18-dien-1-amine (HGT5000), (15Z,18Z)—N,N-dimethyl-6-((9Z,12Z)-octadeca-9,12-dien-1-yl)tetracosa-4,15,18-trien-1-amine (HGT5001), and (15Z,18Z)—N,N-dimethyl-6-((9Z,12Z)-octadeca-9,12-dien-1-yl)tetracosa-5,15,18-trien-1-amine (HGT5002), $C_{12}$-200 (described in WO 2010/053572), 2-(2,2-di((9Z,12Z)-octadeca-9,12-dien-1-yl)-1,3-dioxolan-4-yl)-N,N-dimethylethanamine (DLinKC2-DMA)) (See, WO 2010/042877; Semple et al., Nature Biotech. 28:172-176 (2010)), 2-(2,2-di((9Z,2Z)-octadeca-9,12-dien-1-yl)-1,3-dioxolan-4-yl)-N,N-dimethylethanamine (DLin-KC2-DMA), (3S,10R,13R,17R)-10,13-dimethyl-17-((R)-6-methylheptan-2-yl)-2, 3, 4, 7, 8, 9, 10, 11, 12, 13, 14, 15, 16, 17-tetradecahydro-1H-cyclopenta[a]phenanthren-3-yl 3-(1H-imidazol-4-yl)propanoate (ICE), (15Z,18Z)—N,N-dimethyl-6-((9Z,12Z)-octadeca-9,12-dien-1-yl)tetracosa-15,18-dien-1-amine (HGT5000), (15Z,18Z)—N,N-dimethyl-6-((9Z,12Z)-octadeca-9,12-dien-1-yl)tetracosa-4,15,18-trien-1-amine (HGT5001), (15Z,18 Z)—N,N-dimethyl-6-((9Z,12Z)-octadeca-9,12-dien-1-yl)tetracosa-5,15,18-trien-1-amine (HGT5002), 5-carboxyspermylglycine-dioctadecylamide (DOGS), 2,3-dioleyloxy-N-[2(spermine-carboxamido) ethyl]-N,N-dimethyl-1-propanaminium (DOSPA) (Behr et al. Proc. Nat.'l Acad. Sci. 86, 6982 (1989); U.S. Pat. Nos. 5,171,678; 5,334,761), 1,2-Dioleoyl-3-Dimethylammonium-Propane (DODAP), 1,2-Dioleoyl-3-Trimethylammonium-Propane or (DOTAP). Contemplated ionizable lipids also include 1,2-distearyloxy-N,N-dimethyl-3-aminopropane (DSDMA), 1,2-dioleyloxy-N,N-dimethyl-3-aminopropane (DODMA), 1,2-dilinoleyloxy-N,N-dimethyl-3-aminopropane (DLinDMA), 1,2-dilinolenyloxy-N,N-dimethyl-3-aminopropane (DLenDMA), N-dioleyl-N,N-dimethylammonium chloride (DODAC), N,N-distearyl-N,N-dimethylammonium bromide (DDAB), N-(1,2-dimyristyloxyprop-3-yl)-N,N-dimethyl-N-hydroxyethyl ammonium bromide (DMRIE), 3-dimethylamino-2-(cholest-5-en-3-beta-oxybutan-4-oxy)-1-(cis,cis-9,12-octadecadienoxy)propane (CLinDMA), 2-[5'-(cholest-5-en-3-beta-oxy)-3'-oxapentoxy)-3-dimethyl-1-(cis,cis-9',1-2'-octadecadienoxy)propane (CpLinDMA), N,N-dimethyl-3,4-dioleyloxybenzylamine (DMOBA), 1,2-N,N'-dioleylcarbamyl-3-dimethylaminopropane (DOcarbDAP), 2,3-Dilinoleoyloxy-N,N-dimethylpropylamine (DLinDAP), 1,2-N,N'-Dilinoleylcarbamyl-3-dimethylamninopropane (DLincarbDAP), 1,2-Dilinoleoylcarbamyl-3-dimethylaminopropane (DLinCDAP), 2,2-dilinoleyl-4-dimethylaminomethyl-[1,3]-dioxolane (DLin-K-DMA), 2,2-dilinoleyl-4-dimethylaminoethyl-[1,3]-dioxolane (DLin-K-XTC2-DMA) or GL67, or mixtures thereof (Heyes, J., et al., J Controlled Release 107: 276-287 (2005); Morrissey, D V., et al., Nat. Biotechnol. 23(8): 1003-1007 (2005); PCT Publication WO2005/121348A1). The use of cholesterol-based ionizable lipids to formulate the transfer vehicles (e.g., lipid nanoparticles) is also contemplated by the present invention. Such cholesterol-based ionizable lipids can be used, either alone or in combination with other lipids. Suitable cholesterol-based ionizable lipids include, for example, DC-Cholesterol (N,N-dimethyl-N-ethylcarboxamidocholesterol), and 1,4-bis(3-N-oleylamino-propyl)piperazine (Gao, et al., Biochem. Biophys. Res. Comm. 179, 280 (1991); Wolf et al. BioTechniques 23, 139 (1997); U.S. Pat. No. 5,744,335).

Also contemplated are cationic lipids such as dialkylamino-based, imidazole-based, and guanidinium-based lipids. For example, also contemplated is the use of the ionizable lipid (3 S,10R, 13R, 17R)-10,13-dimethyl-17-((R)-6-methylheptan-2-yl)-2, 3, 4, 7, 8, 9, 10, 11, 12, 13, 14, 15, 16, 17-tetradecahydro-1H-cyclopenta[a]phenanthren-3-yl 3-(1H-imidazol-4-yl)propanoate (ICE), as disclosed in International Application No. PCT/US2010/058457, incorporated herein by reference.

Also contemplated are ionizable lipids such as the dialkylamino-based, imidazole-based, and guanidinium-based lipids. For example, certain embodiments are directed to a composition comprising one or more imidazole-based ionizable lipids, for example, the imidazole cholesterol ester or "ICE" lipid, (3S,10R, 13R, 17R)-10, 13-dimethyl-17-((R)-6-methylheptan-2-yl)-2, 3, 4, 7, 8, 9, 10, 11, 12, 13, 14, 15, 16, 17-tetradecahydro-1H-cyclopenta[a]phenanthren-3-yl 3-(1H-imidazol-4-yl)propanoate, as represented by structure (XIII) below. In an embodiment, a transfer vehicle for delivery of circRNA may comprise one or more imidazole-based ionizable lipids, for example, the imidazole cholesterol ester or "ICE" lipid (3S,10R, 13R, 17R)-10, 13-dimethyl-17-((R)-6-methylheptan-2-yl)-2, 3, 4, 7, 9, 10, 11, 12, 13, 14, 15, 16, 17-tetradecahydro-1H-cyclopenta[a] phenanthren-3-yl 3-(1H-imidazol-4-yl)propanoate, as represented by structure (XIII).

(XIII)

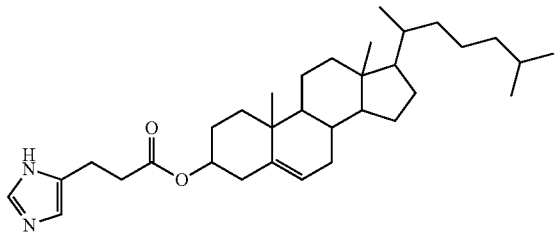

Without wishing to be bound by a particular theory, it is believed that the fusogenicity of the imidazole-based cationic lipid ICE is related to the endosomal disruption which is facilitated by the imidazole group, which has a lower pKa relative to traditional ionizable lipids. The endosomal disruption in turn promotes osmotic swelling and the disruption of the liposomal membrane, followed by the transfection or intracellular release of the nucleic acid(s) contents loaded therein into the target cell.

The imidazole-based ionizable lipids are also characterized by their reduced toxicity relative to other ionizable lipids.

In some embodiments, an ionizable lipid is described by US patent publication number 20190314284. In certain embodiments, the an ionizable lipid is described by structure 3, 4, 5, 6, 7, 8, 9, or 10 (e.g., HGT4001, HGT4002, HGT4003, HGT4004 and/or HGT4005). In certain embodiments, the one or more cleavable functional groups (e.g., a disulfide) allow, for example, a hydrophilic functional headgroup to dissociate from a lipophilic functional tail-group of the compound (e.g., upon exposure to oxidative, reducing or acidic conditions), thereby facilitating a phase transition in the lipid bilayer of the one or more target cells. For example, when a transfer vehicle (e.g., a lipid nanoparticle) comprises one or more of the lipids of structures 3-10, the phase transition in the lipid bilayer of the one or more target cells facilitates the delivery of the circRNA into the one or more target cells.

In certain embodiments, the ionizable lipid is described by structure (XIV), (XIV)

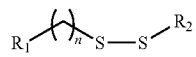

wherein:
R$_1$ is selected from the group consisting of imidazole, guanidinium, amino, imine, enamine, an optionally-substituted alkyl amino (e.g., an alkyl amino such as dimethylamino) and pyridyl;
R$_2$ is selected from the group consisting of structure XV and structure XVI;

XV

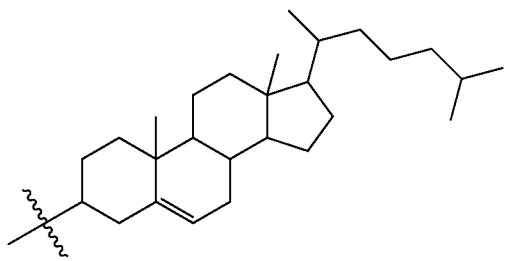

XVI

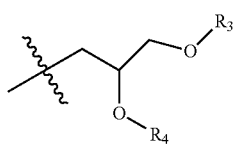

wherein R₃ and R₄ are each independently selected from the group consisting of an optionally substituted, variably saturated or unsaturated $C_6$-$C_{20}$ alkyl and an optionally substituted, variably saturated or unsaturated $C_6$-$C_{20}$ acyl; and wherein n is zero or any positive integer (e.g., one, two, three, four, five, six, seven, eight, nine, ten, eleven, twelve, thirteen, fourteen, fifteen, sixteen, seventeen, eighteen, nineteen, twenty or more). In certain embodiments, R₃ and R₄ are each an optionally substituted, polyunsaturated Cis alkyl, while in other embodiments R₃ and R₄ are each an unsubstituted, polyunsaturated Cis alkyl. In certain embodiments, one or more of R₃ and R₄ are (9Z,12Z)-octadeca-9,12-dien.

Also disclosed herein are pharmaceutical compositions that comprise the compound of structure XIV, wherein R₁ is selected from the group consisting of imidazole, guanidinium, amino, imine, enamine, an optionally-substituted alkyl amino (e.g., an alkyl amino such as dimethylamino) and pyridyl; wherein R₂ is structure XV; and wherein n is zero or any positive integer. Further disclosed herein are pharmaceutical compositions comprising the compound of structure XIV, wherein R₁ is selected from the group consisting of imidazole, guanidinium, amino, imine, enamine, an optionally-substituted alkyl amino (e.g., an alkyl amino such as dimethylamino) and pyridyl; wherein R₂ is structure XVI; wherein R₃ and R₄ are each independently selected from the group consisting of an optionally substituted, variably saturated or unsaturated $C_6$-$C_{20}$ alkyl and an optionally substituted, variably saturated or unsaturated $C_6$-$C_{20}$ acyl; and wherein n is zero or any positive integer. In certain embodiments. R₃ and R₄ are each an optionally substituted, polyunsaturated Cis alkyl, while in other embodiments R₃ and R₄ are each an unsubstituted, polyunsaturated Cis alkyl (e.g., octadeca-9,12-dien).

In certain embodiments, the R₁ group or head-group is a polar or hydrophilic group (e.g., one or more of the imidazole, guanidinium and amino groups) and is bound to the R₂ lipid group by way of the disulfide (S—S) cleavable linker group, for example as depicted in structure XIV. Other contemplated cleavable linker groups may include compositions that comprise one or more disulfide (S—S) linker group bound (e.g., covalently bound) to, for example an alkyl group (e.g., $C_1$ to $C_{10}$alkyl). In certain embodiments, the R₁ group is covalently bound to the cleavable linker group by way of a $C_1$-$C_{20}$ alkyl group (e.g., where n is one to twenty), or alternatively may be directly bound to the cleavable linker group (e.g., where n is zero). In certain embodiments, the disulfide linker group is cleavable in vitro and/or in vivo (e.g., enzymatically cleavable or cleavable upon exposure to acidic or reducing conditions).

In certain embodiments, the inventions relate to the compound 5-(((10,13-dimethyl-17-(6-methylheptan-2-yl)-2,3,4,7,8,9,10,11,12,13,14,15,16,17-tetradecahydro-1H-cyclopenta[a]phenanthren-3-yl)disulfanyl)methyl)-1H-imidazole, having structure XVII (referred to herein as "HGT4001").

XVII

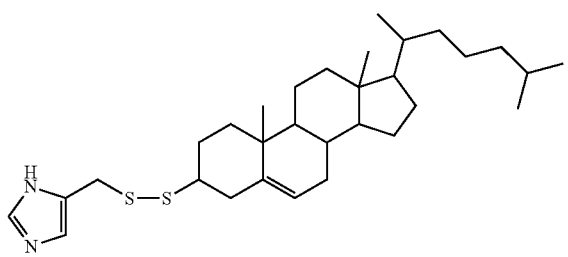

In certain embodiments, the inventions relate to the compound 1-(2-(((3S,10R,13R)-10,13-dimethyl-17-((R)-6-methylheptan-2-yl)-2,3,4,7,8,9,10,11,12,13,14,15,16,17-tetradecahydro-1H-cyclopenta[a]phenanthren-3-yl)disulfanyl)ethyl)guanidine, having structure XVIII (referred to herein as "HGT4002").

XVIII

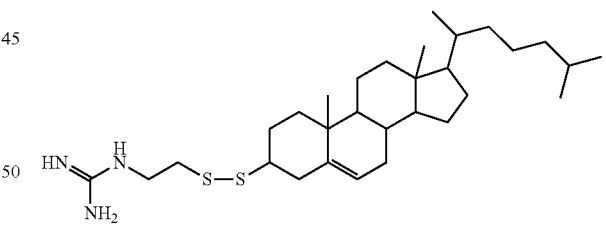

In certain embodiments, the inventions relate to the compound 2-((2,3-Bis((9Z,12Z)-octadeca-9,12-dien-1-yloxy)propyl)disulfanyl)-N,N-dimethylethanamine, having structure XIX (referred to herein as "HGT4003").

XIX

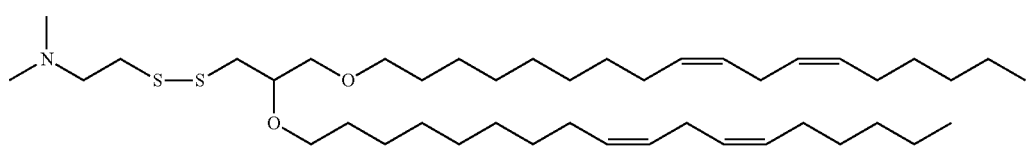

In other embodiments, the inventions relate to the compound 5-(((2,3-bis((9Z,12Z)-octadeca-9,12-dien-1-yloxy)propyl)disulfanyl)methyl)-1H-imidazole having the structure of structure XX (referred to herein as "HGT4004").

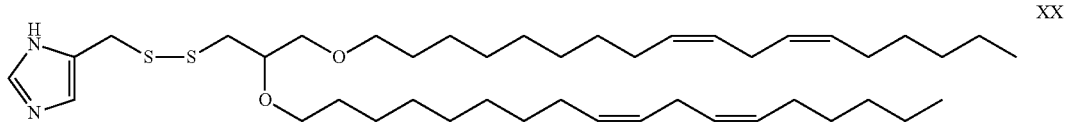 [SMILES: CCCCC/C=C\C/C=C\CCCCCCCCOCC(CSSCc1cnc[nH]1)OCCCCCCCC/C=C\C/C=C\CCCCC]
XX

In still other embodiments, the inventions relate to the compound 1-(((2,3-bis((9Z,12Z)-octadeca-9,12-dien-1-yloxy)propyl)disulfanyl)methyl)guanidine having structure XXI (referred to herein as "HGT4005").

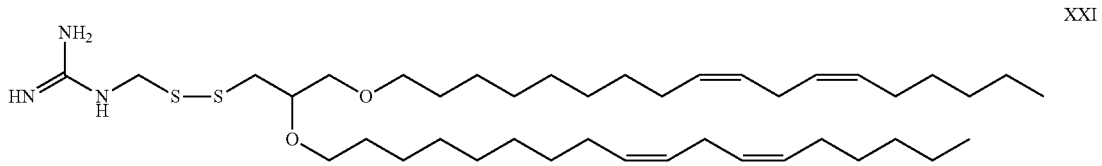 [SMILES: CCCCC/C=C\C/C=C\CCCCCCCCOCC(CSSCNC(=N)N)OCCCCCCCC/C=C\C/C=C\CCCCC]
XXI

In certain embodiments, the compounds described as structures 3-10 are ionizable lipids.

The compounds, and in particular the imidazole-based compounds described as structures 3-8 (e.g., HGT4001 and HGT4004), are characterized by their reduced toxicity, in particular relative to traditional ionizable lipids. In some embodiments, the transfer vehicles described herein comprise one or more imidazole-based ionizable lipid compounds such that the relative concentration of other more toxic ionizable lipids in such pharmaceutical or liposomal composition may be reduced or otherwise eliminated.

The ionizable lipids include those disclosed in international patent application PCT/US2019/025246, and US patent publications 2017/0190661 and 2017/0114010, incorporated herein by reference in their entirety. The ionizable lipids may include a lipid selected from the following tables 12, 13, 14, or 15.

TABLE 12

ATX-001
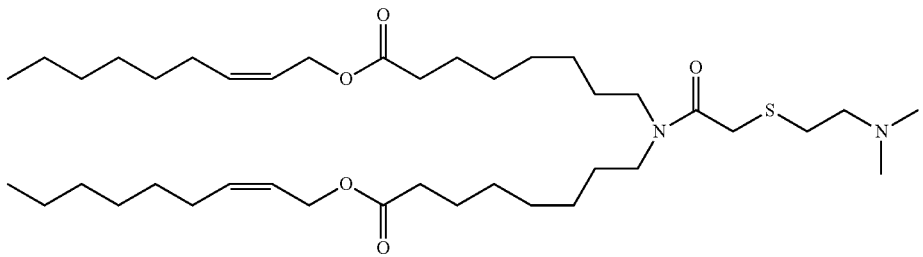 [SMILES: CCCCCC/C=C\COC(=O)CCCCCCCN(CCCCCCCC(=O)OC/C=C\CCCCCC)C(=O)CSCCN(C)C]

ATX-002
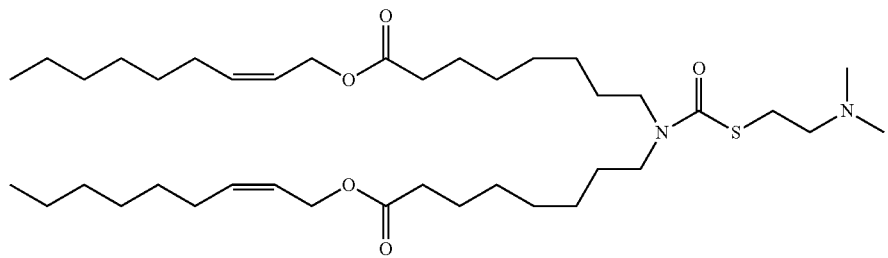 [SMILES: CCCCCC/C=C\COC(=O)CCCCCCCN(CCCCCCCC(=O)OC/C=C\CCCCCC)C(=O)SCCN(C)C]

ATX-003
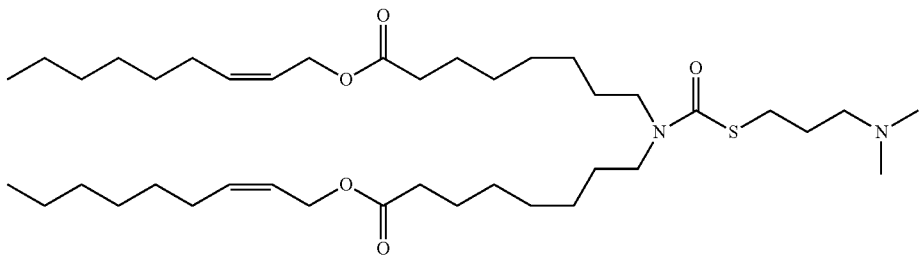 [SMILES: CCCCCC/C=C\COC(=O)CCCCCCCN(CCCCCCCC(=O)OC/C=C\CCCCCC)C(=O)SCCCN(C)C]

TABLE 12-continued
ATX-004
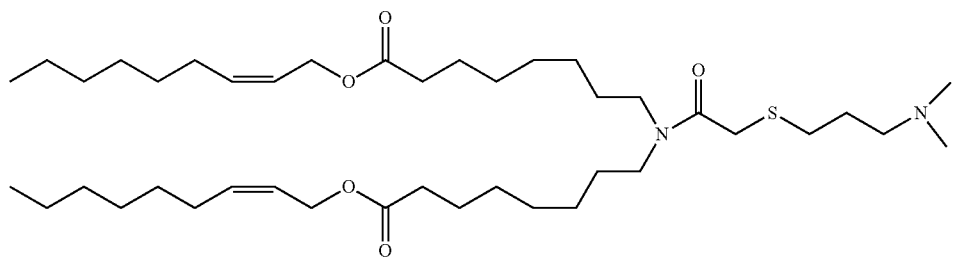 [SMILES: CCCCCC/C=C\COC(=O)CCCCCCCN(CCCCCCCC(=O)OC/C=C\CCCCCC)C(=O)CSCCCN(C)C]
ATX-005
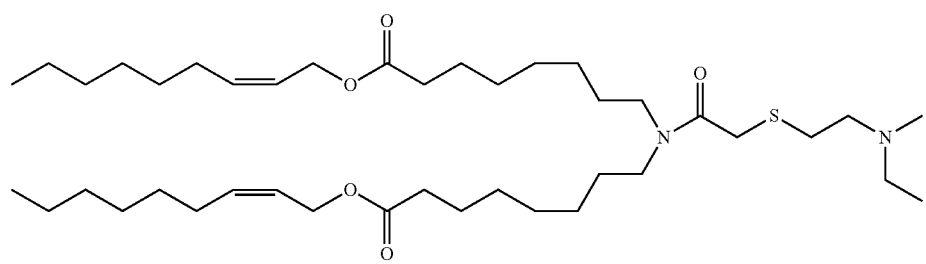 [SMILES: CCCCCC/C=C\COC(=O)CCCCCCCN(CCCCCCCC(=O)OC/C=C\CCCCCC)C(=O)CSCCN(C)CC]
ATX-006
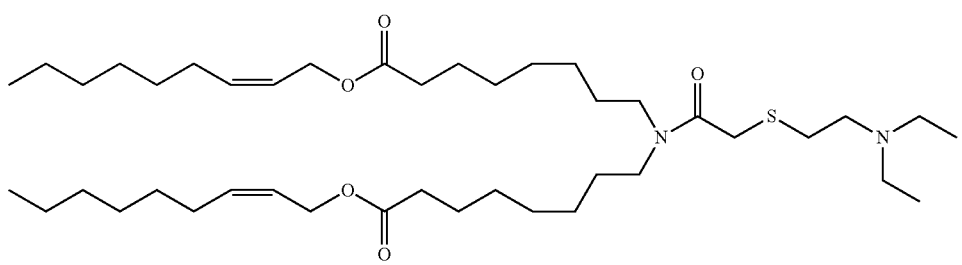 [SMILES: CCCCCC/C=C\COC(=O)CCCCCCCN(CCCCCCCC(=O)OC/C=C\CCCCCC)C(=O)CSCCN(CC)CC]
ATX-007
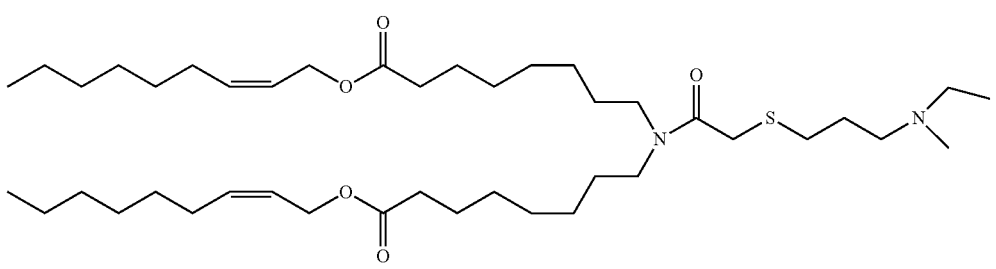 [SMILES: CCCCCC/C=C\COC(=O)CCCCCCCN(CCCCCCCC(=O)OC/C=C\CCCCCC)C(=O)CSCCCN(C)CC]
ATX-008
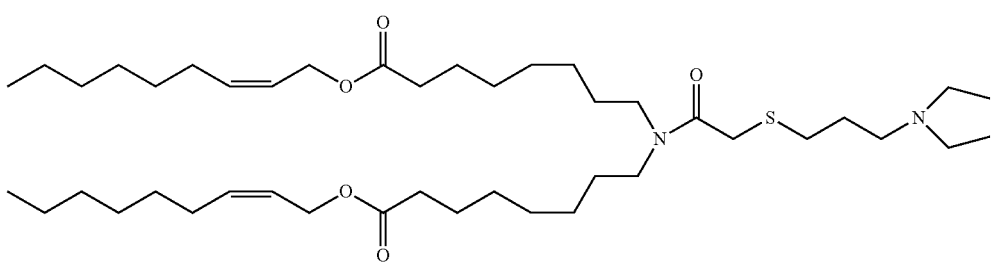 [SMILES: CCCCCC/C=C\COC(=O)CCCCCCCN(CCCCCCCC(=O)OC/C=C\CCCCCC)C(=O)CSCCCN(CC)CC]
ATX-009
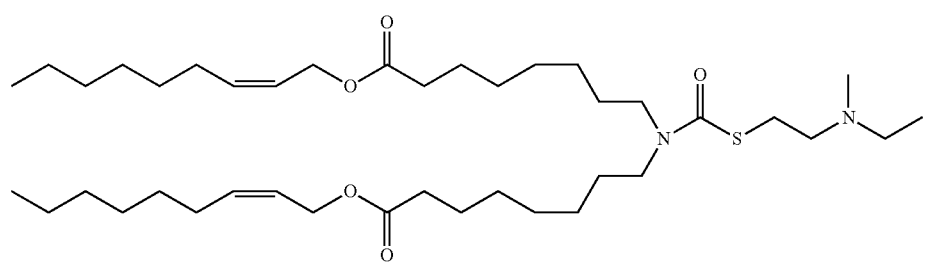 [SMILES: CCCCCC/C=C\COC(=O)CCCCCCCN(CCCCCCCC(=O)OC/C=C\CCCCCC)C(=O)SCCN(C)CC]

TABLE 12-continued

ATX-010

ATX-011

ATX-012

ATX-013

ATX-014

ATX-015

ATX-016

TABLE 12-continued
ATX-017
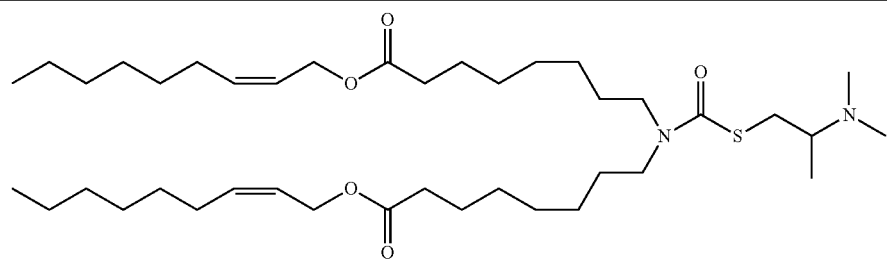
ATX-018
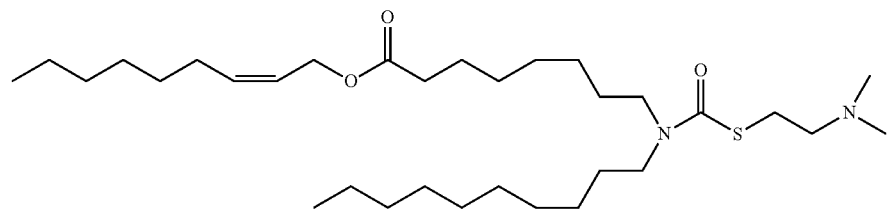 [SMILES: CCCCCC/C=C\COC(=O)CCCCCCCN(CCCCCCCCCC)C(=O)SCCN(C)C]
ATX-019
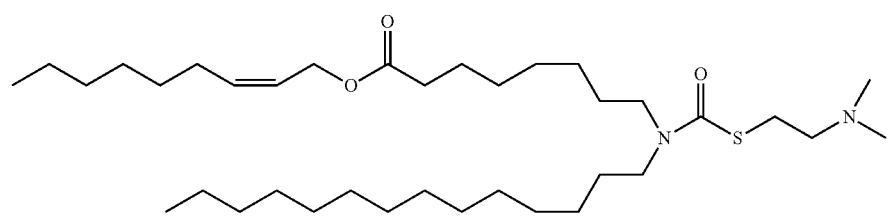 [SMILES: CCCCCC/C=C\COC(=O)CCCCCCCN(CCCCCCCCCCCCCC)C(=O)SCCN(C)C]
ATX-020
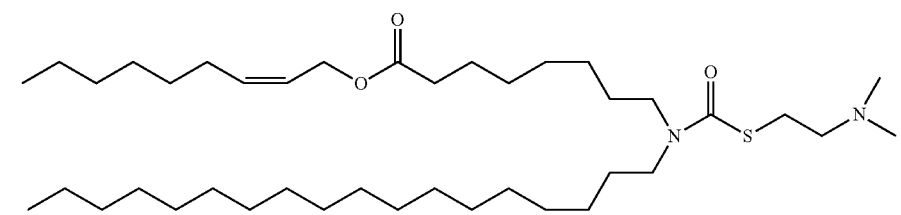 [SMILES: CCCCCC/C=C\COC(=O)CCCCCCCN(CCCCCCCCCCCCCCCCCC)C(=O)SCCN(C)C]
ATX-021
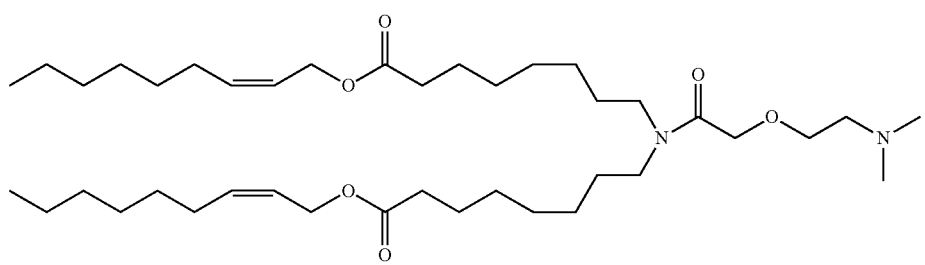
ATX-022
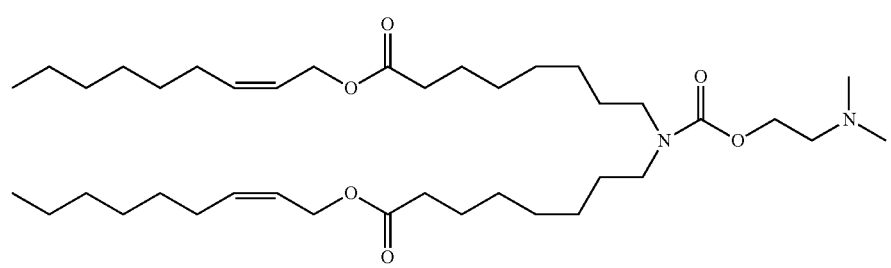
ATX-023
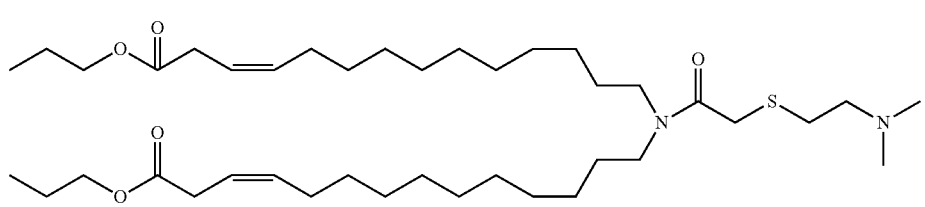 [SMILES: CCCOC(=O)C/C=C\CCCCCCCCCCN(CCCCCCCCCC/C=C\CC(=O)OCCC)C(=O)CSCCN(C)C]

TABLE 12-continued
ATX-024
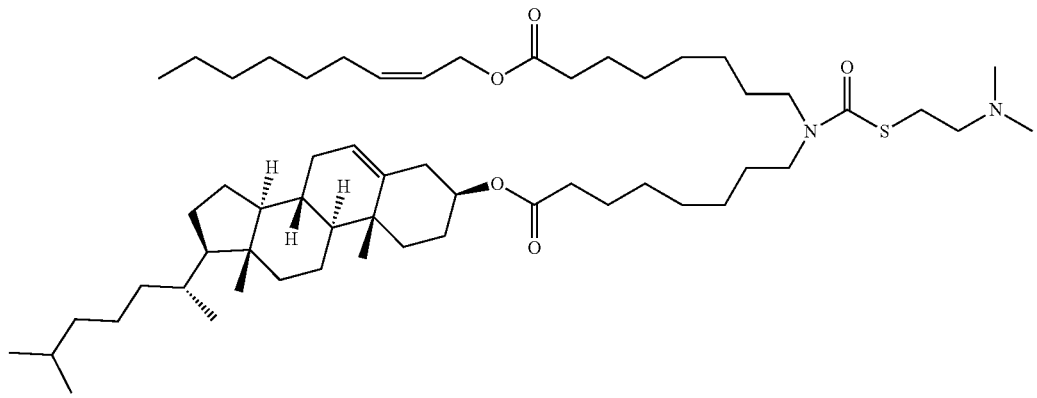
ATX-025
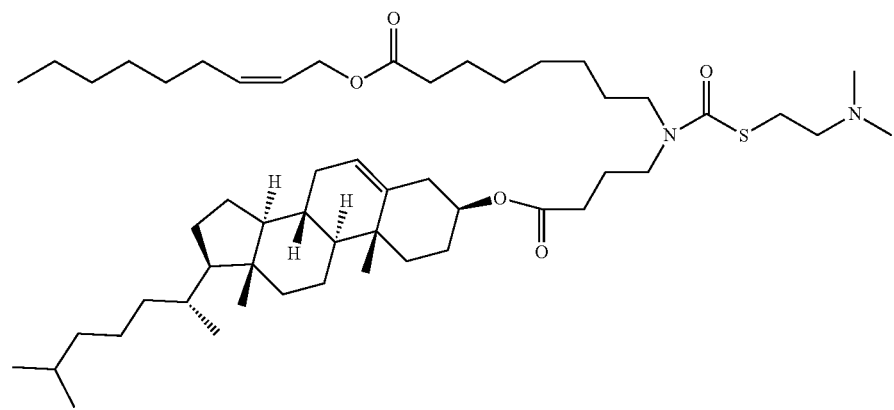
ATX-026
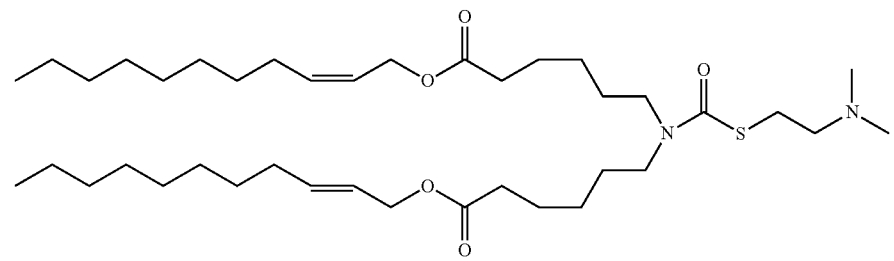 [SMILES: CCCCCCCC/C=C\COC(=O)CCCCCN(CCCCCC(=O)OC/C=C/CCCCCCCC)C(=O)SCCN(C)C]
ATX-027
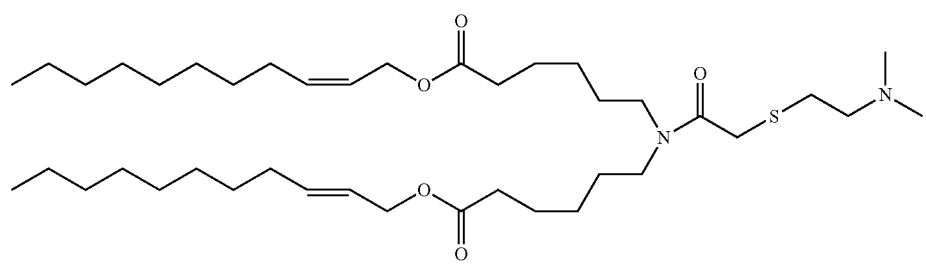 [SMILES: CCCCCCCC/C=C\COC(=O)CCCCCN(CCCCCC(=O)OC/C=C/CCCCCCCC)C(=O)CSCCN(C)C]
ATX-028
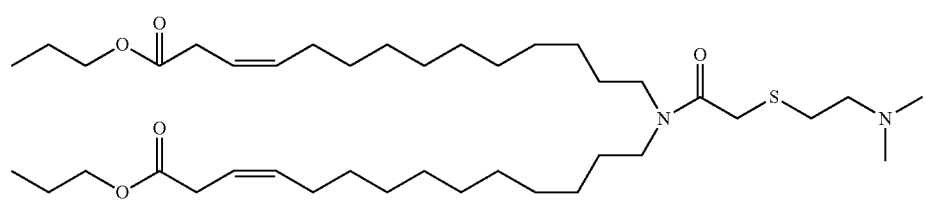 [SMILES: CCCOC(=O)C/C=C\CCCCCCCCCCN(CCCCCCCCCC/C=C\CC(=O)OCCC)C(=O)CSCCN(C)C]

TABLE 12-continued
ATX-029
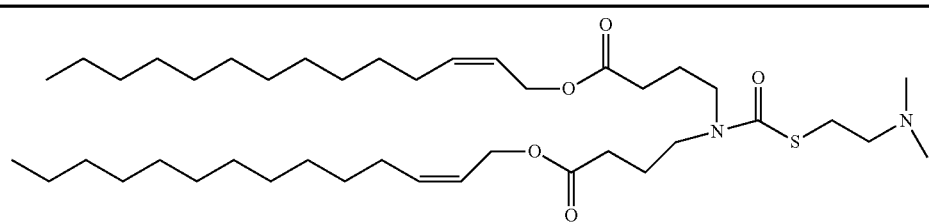
ATX-030
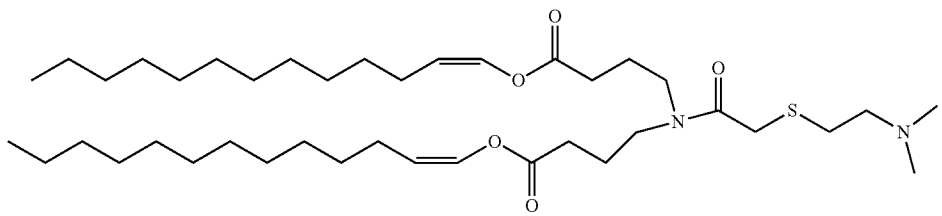 [SMILES: CCCCCCCCCCC/C=C\OC(=O)CCCN(CCCC(=O)O/C=C\CCCCCCCCCCC)C(=O)CSCCN(C)C]
ATX-031
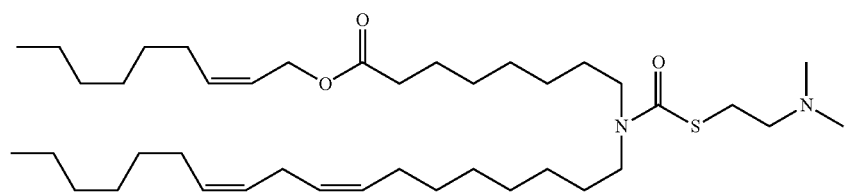 [SMILES: CCCCCC/C=C\C/C=C\CCCCCCCN(CCCCCCCC(=O)OC/C=C\CCCCCC)C(=O)SCCN(C)C]
ATX-032
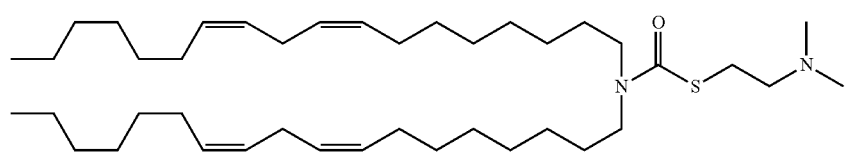
TABLE 13
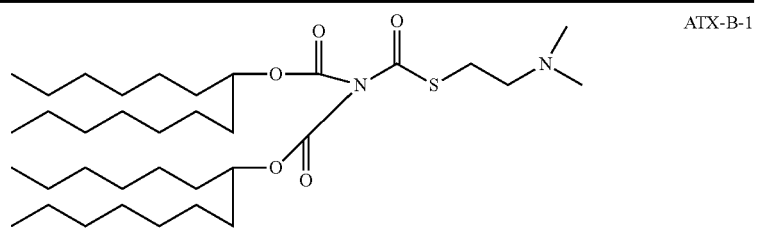
ATX-B-1
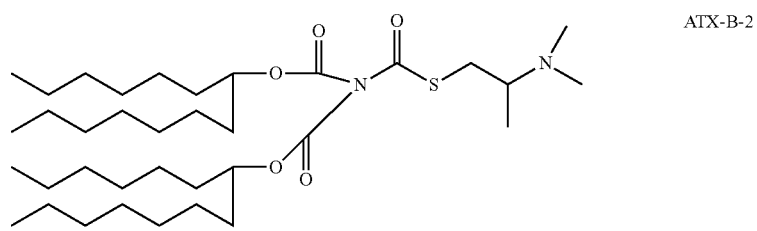
ATX-B-2
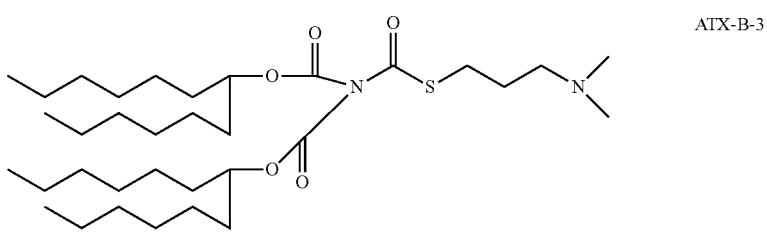
ATX-B-3

TABLE 13-continued
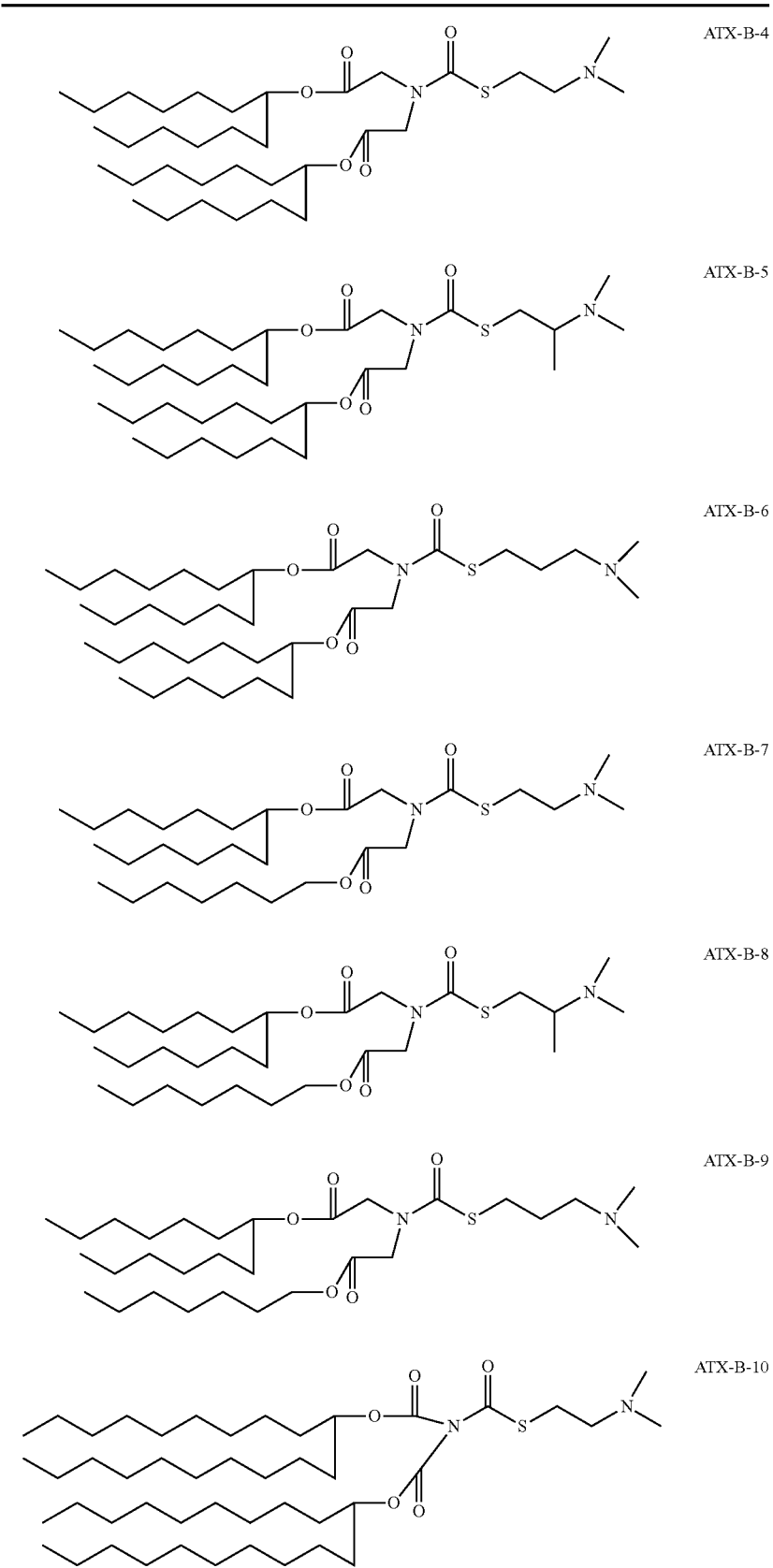

TABLE 13-continued
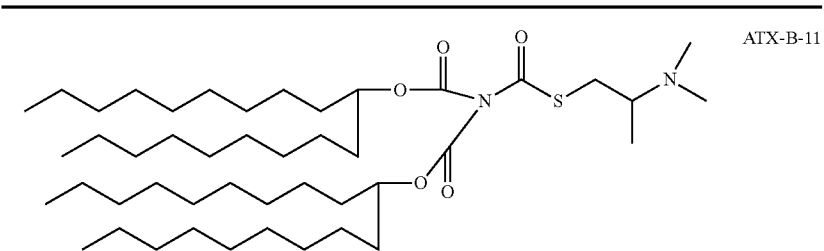
ATX-B-11
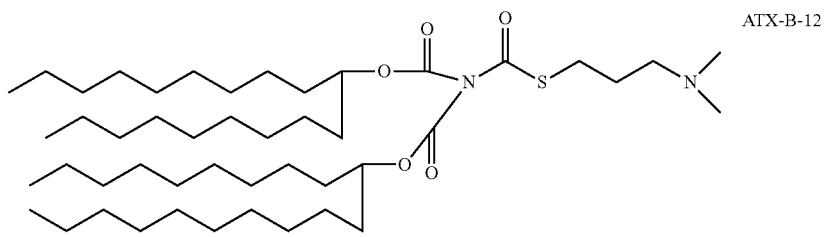
ATX-B-12
TABLE 14
| Compound | ATX-# |
|---|---|
| 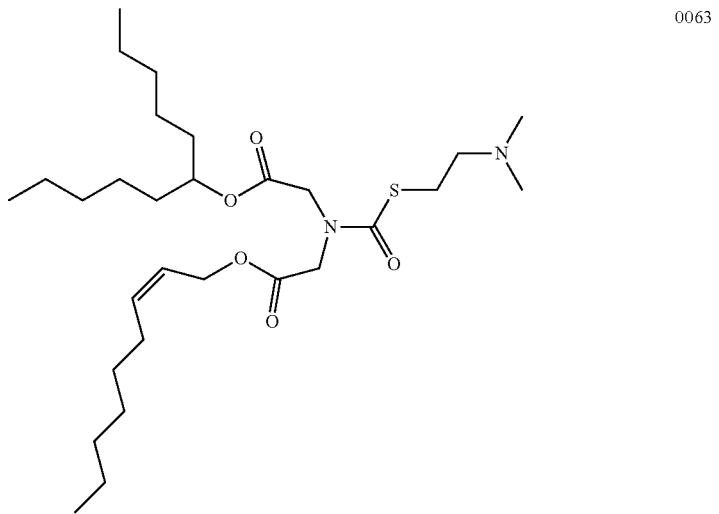 | 0063 |
| 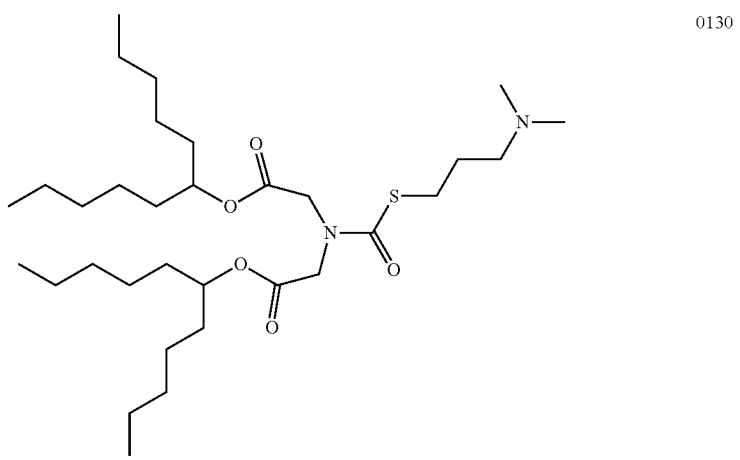 | 0130 |

TABLE 14-continued

| Compound | ATX-# |
|---|---|
| | 0131 |
| | 0044 |
| | 0111 |

TABLE 14-continued
| Compound | ATX-# |
|---|---|
| 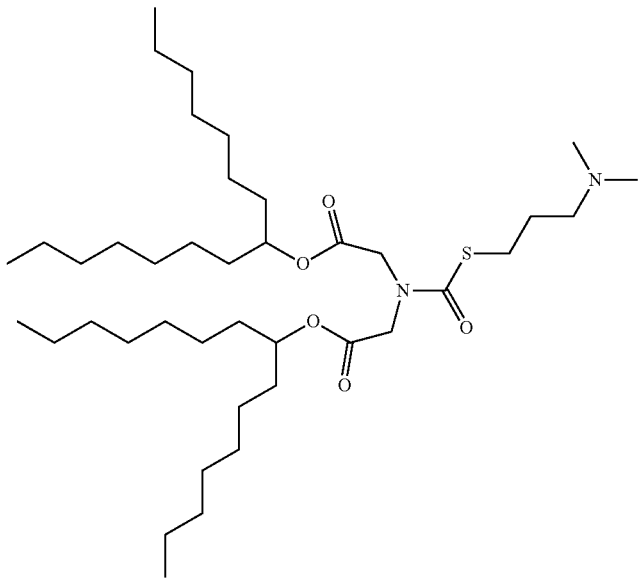 [SMILES: CCCCCCCC(CCCCCCC)OC(=O)CN(CC(=O)OC(CCCCCCC)CCCCCCC)C(=O)SCCCN(C)C] | 0132 |
| 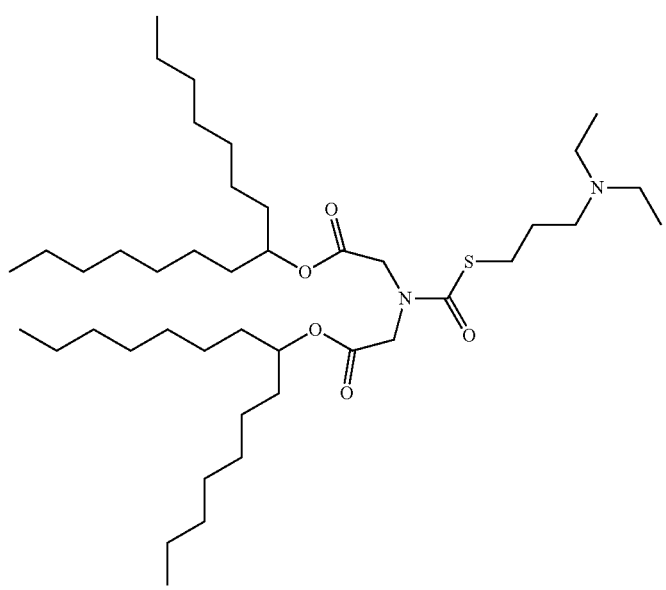 [SMILES: CCCCCCCC(CCCCCCC)OC(=O)CN(CC(=O)OC(CCCCCCC)CCCCCCC)C(=O)SCCCN(CC)CC] | 0134 |

TABLE 14-continued
| Compound | ATX-# |
|---|---|
| 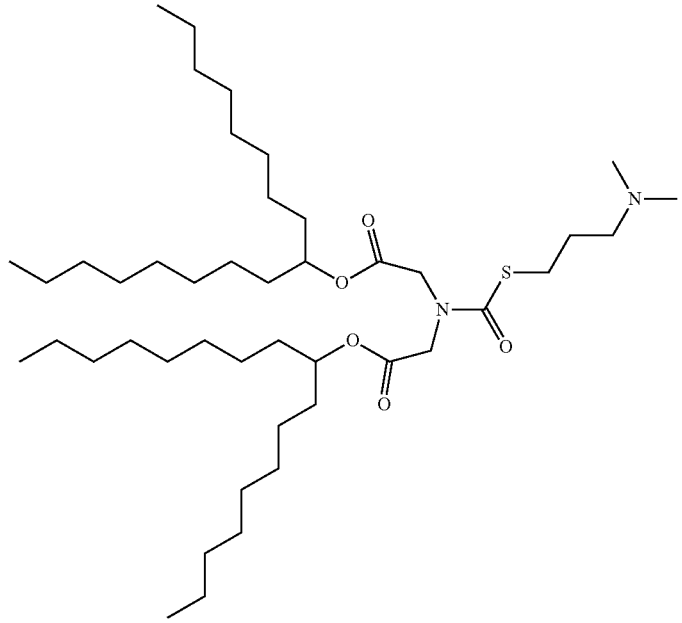 [SMILES: CCCCCCCCC(CCCCCCCC)OC(=O)CN(CC(=O)OC(CCCCCCCC)CCCCCCCC)C(=O)SCCCN(C)C] | 0133 |
| 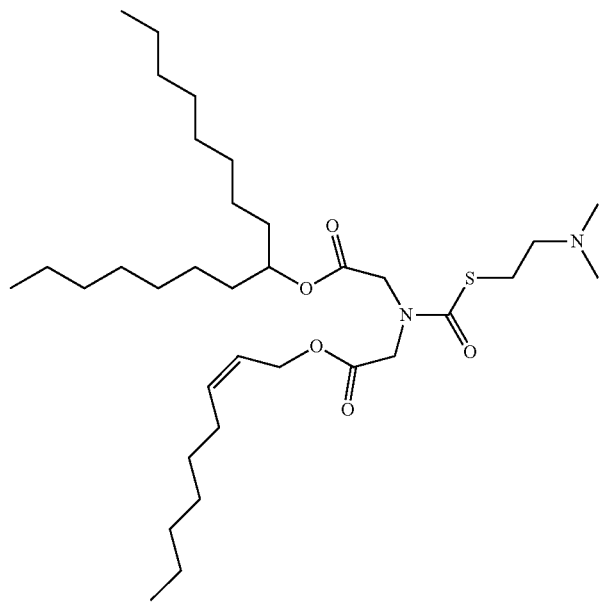 [SMILES: CCCCCC/C=C\COC(=O)CN(CC(=O)OC(CCCCCCC)CCCCCCCC)C(=O)SCCN(C)C] | 0064 |

TABLE 14-continued
| Compound | ATX-# |
|---|---|
| 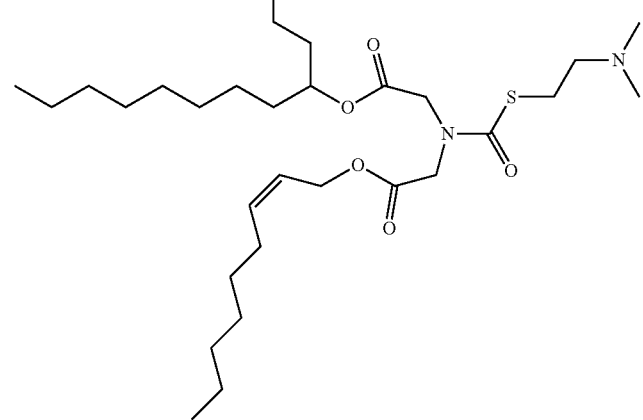 | 0061 |
| 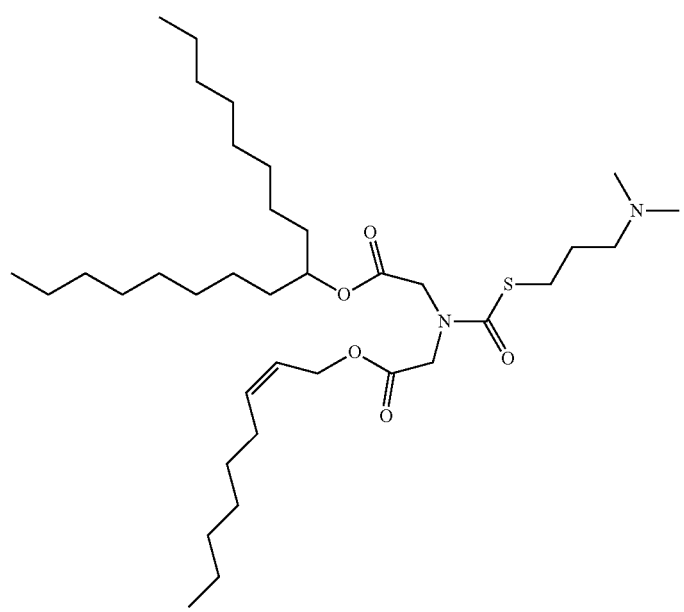 [SMILES: CCCCCC/C=C\COC(=O)CN(CC(=O)OC(CCCCCCCC)CCCCCCCC)C(=O)SCCCN(C)C] | 0100 |

TABLE 14-continued
| Compound | ATX-# |
|---|---|
| 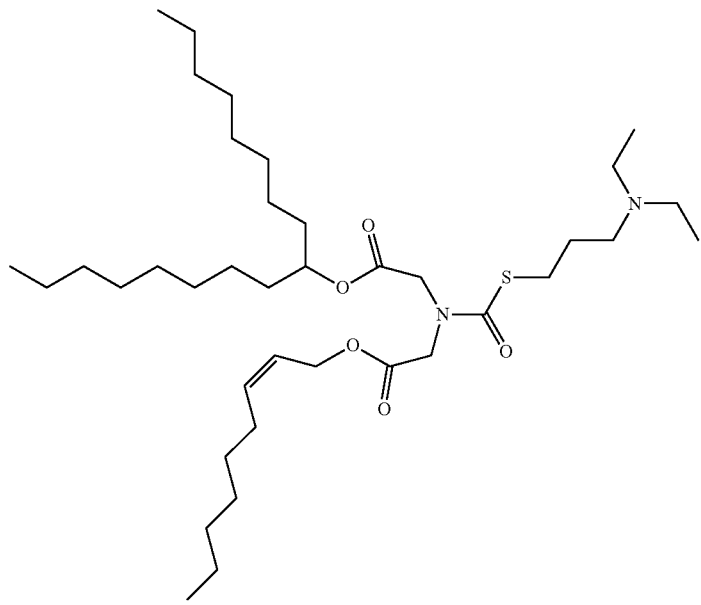 [SMILES: CCCCCC/C=C\COC(=O)CN(CC(=O)OC(CCCCCCCC)CCCCCCCC)C(=O)SCCCN(CC)CC] | 0117 |
| 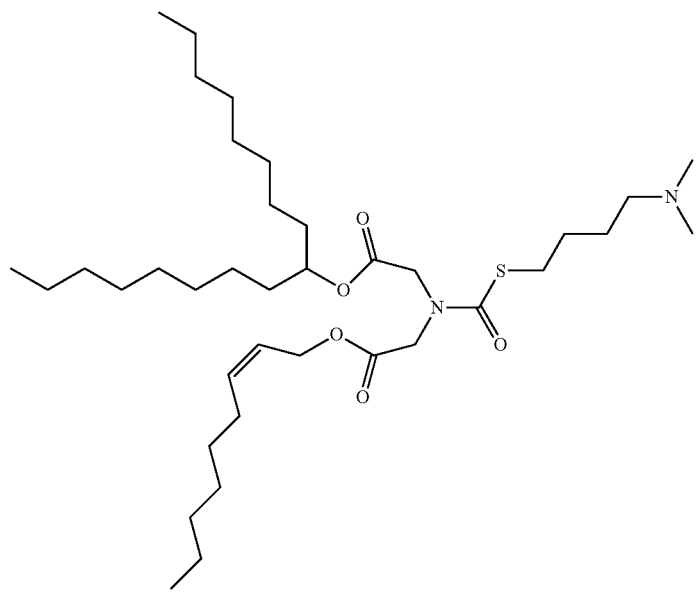 [SMILES: CCCCCC/C=C\COC(=O)CN(CC(=O)OC(CCCCCCCC)CCCCCCCC)C(=O)SCCCCN(C)C] | 0114 |

TABLE 14-continued

| Compound | ATX-# |
|---|---|
| | 0115 |
| | 0101 |
| | 0106 |

TABLE 14-continued
| Compound | ATX-# |
|---|---|
| 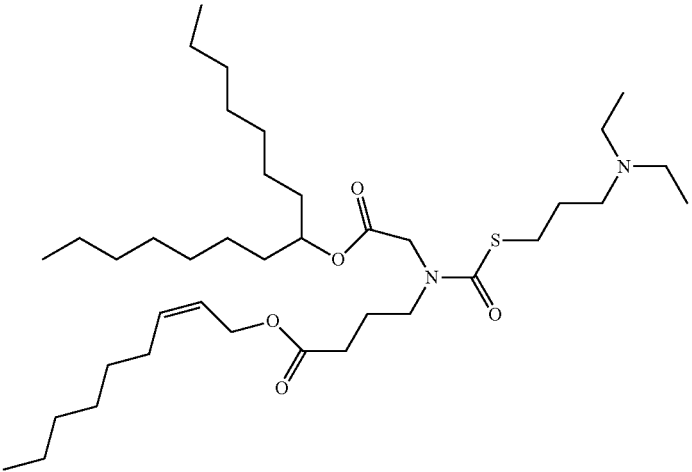 [SMILES: CCCCCC/C=C\COC(=O)CCCN(CC(=O)OC(CCCCCCC)CCCCCCC)C(=O)SCCCN(CC)CC] | 0116 |
| 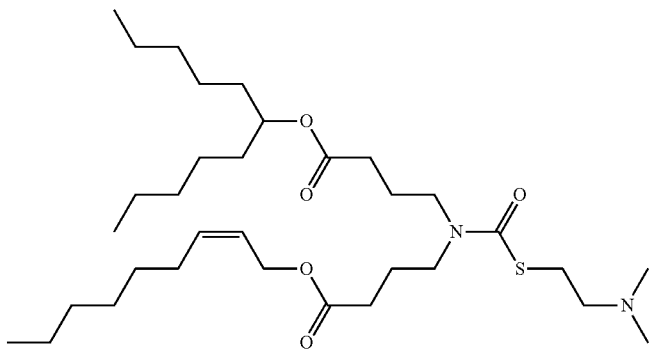 [SMILES: CCCCCC/C=C\COC(=O)CCCN(CCCC(=O)OC(CCCCC)CCCCC)C(=O)SCCN(C)C] | 0043 |
| 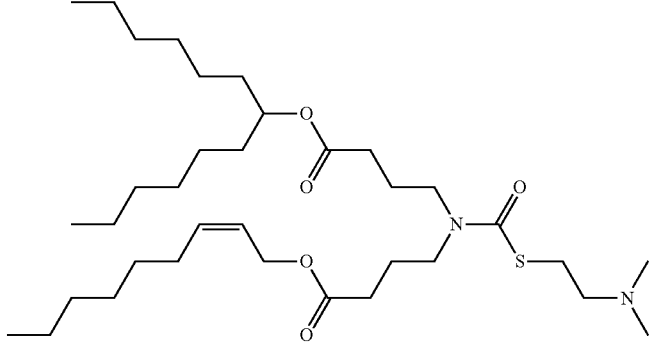 [SMILES: CCCCCC/C=C\COC(=O)CCCN(CCCC(=O)OC(CCCCCC)CCCCCC)C(=O)SCCN(C)C] | 0086 |
| 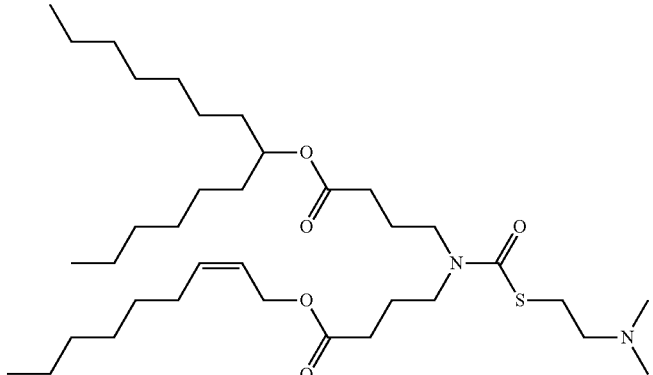 | 0058 |

TABLE 14-continued

| Compound | ATX-# |
|---|---|
| (structure) | 0081 |
| (structure) | 0123 |
| (structure) | 0122 |
| (structure) | 0057 |

TABLE 14-continued
| Compound | ATX-# |
|---|---|
| 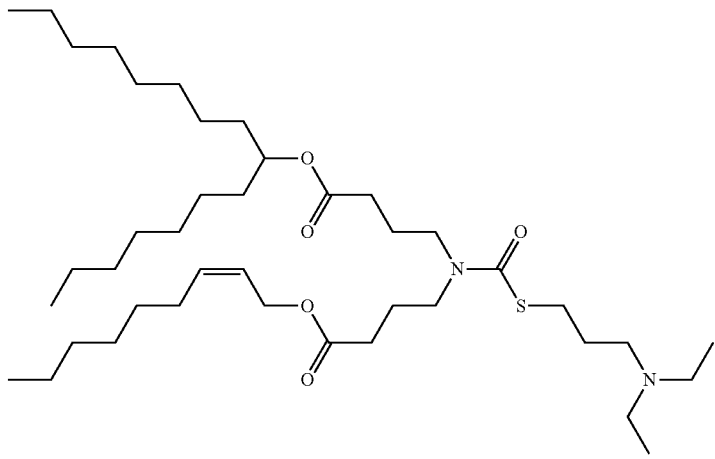 [SMILES: CCCCCC/C=C\COC(=O)CCCN(CCCC(=O)OC(CCCCCCC)CCCCCCCC)C(=O)SCCCN(CC)CC] | 0088 |
| 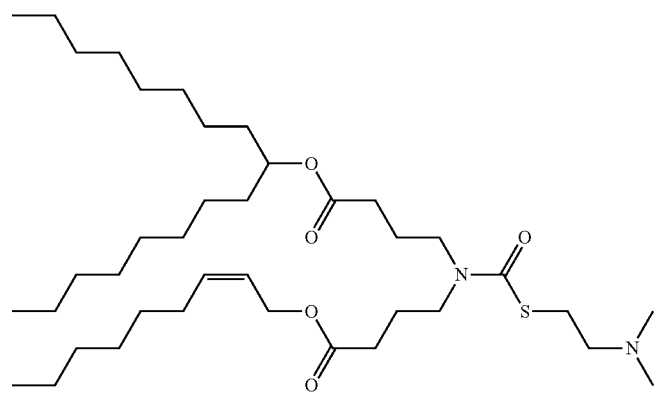 [SMILES: CCCCCC/C=C\COC(=O)CCCN(CCCC(=O)OC(CCCCCCCC)CCCCCCCC)C(=O)SCCN(C)C] | 0087 |
| 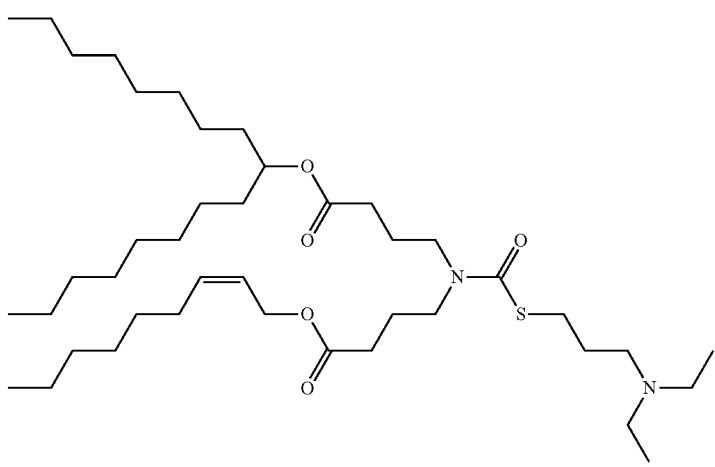 [SMILES: CCCCCC/C=C\COC(=O)CCCN(CCCC(=O)OC(CCCCCCCC)CCCCCCCC)C(=O)SCCCN(CC)CC] | 0124 |

TABLE 14-continued
| Compound | ATX-# |
|---|---|
| 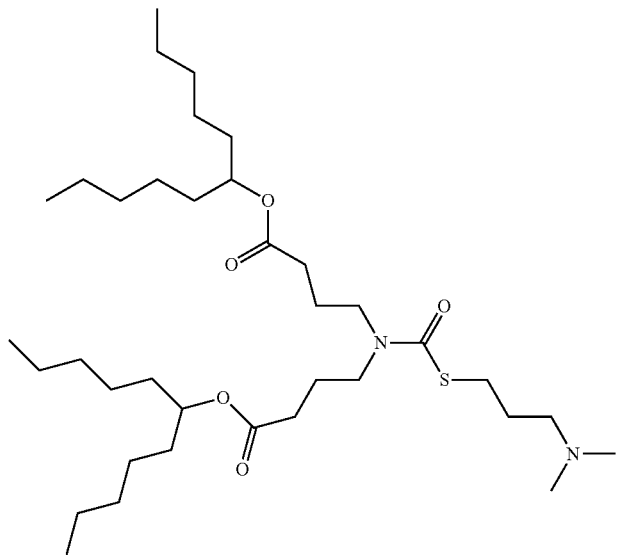 [SMILES: CCCCCC(CCCCC)OC(=O)CCCN(CCCC(=O)OC(CCCCC)CCCCC)C(=O)SCCCN(C)C] | 0128 |
| 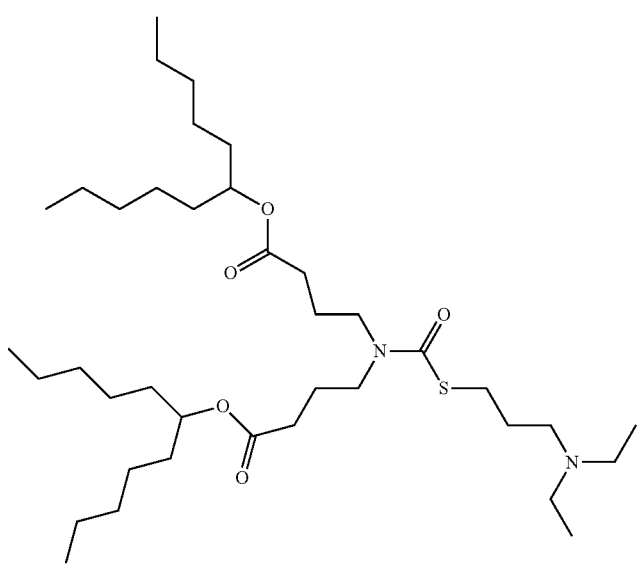 [SMILES: CCCCCC(CCCCC)OC(=O)CCCN(CCCC(=O)OC(CCCCC)CCCCC)C(=O)SCCCN(CC)CC] | 0127 |

TABLE 14-continued
| Compound | ATX-# |
|---|---|
| 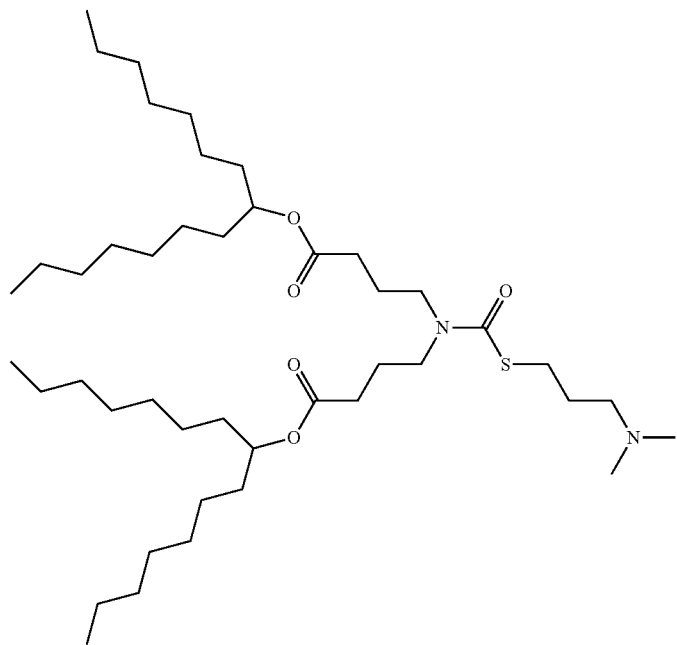 [SMILES: CCCCCCCC(CCCCCCC)OC(=O)CCCN(CCCC(=O)OC(CCCCCCC)CCCCCCC)C(=O)SCCCN(C)C] | 0126 |
| 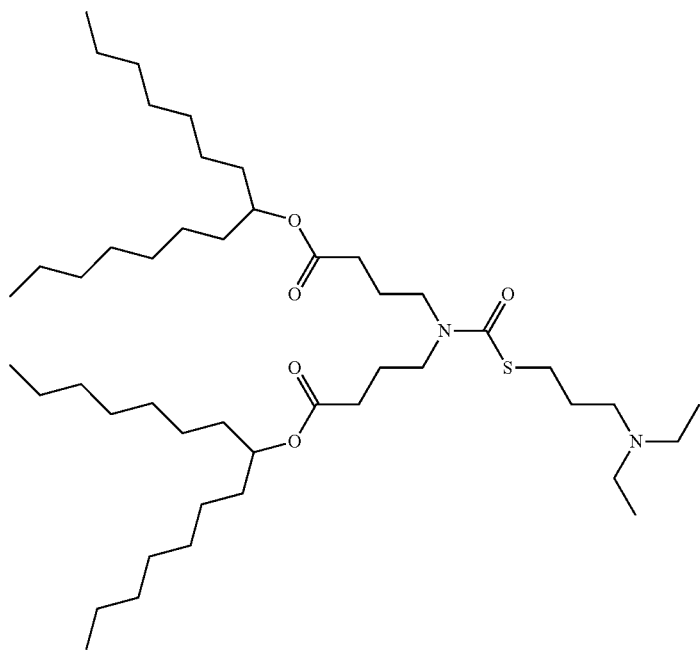 [SMILES: CCCCCCCC(CCCCCCC)OC(=O)CCCN(CCCC(=O)OC(CCCCCCC)CCCCCCC)C(=O)SCCCN(CC)CC] | 0129 |

TABLE 14-continued
| Compound | ATX-# |
|---|---|
| 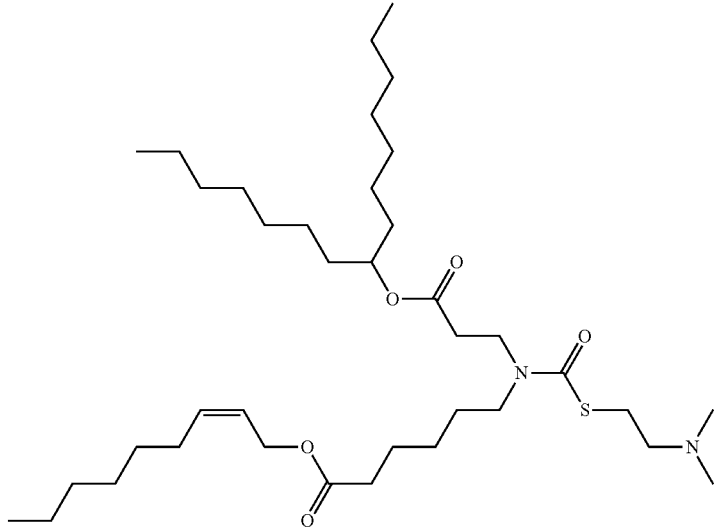 [SMILES: CCCCCC/C=C\COC(=O)CCCCCN(CCC(=O)OC(CCCCCCC)CCCCCCC)C(=O)SCCN(C)C] | 0082 |
| 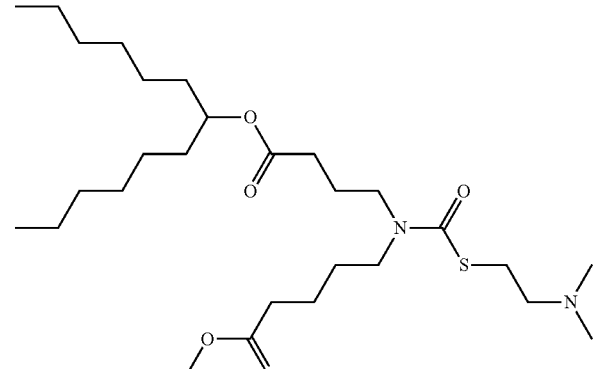 | 0085 |
|  | 0083 |

TABLE 14-continued
| Compound | ATX-# |
|---|---|
| 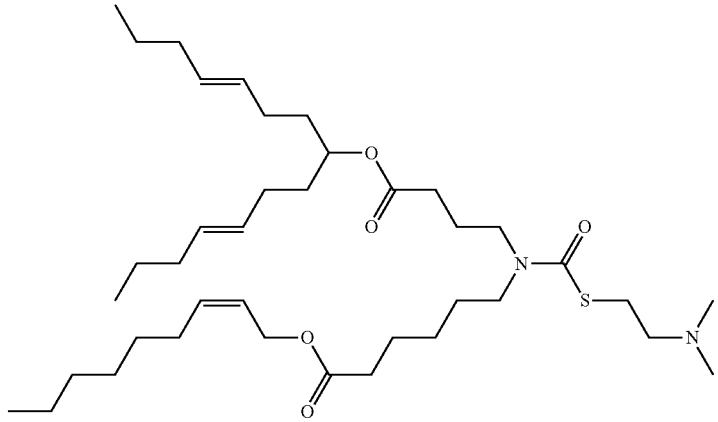 [SMILES: CCC/C=C/CCC(CC/C=C/CCC)OC(=O)CCCN(CCCCCC(=O)OC/C=C\CCCCCC)C(=O)SCCN(C)C] | 0121 |
| 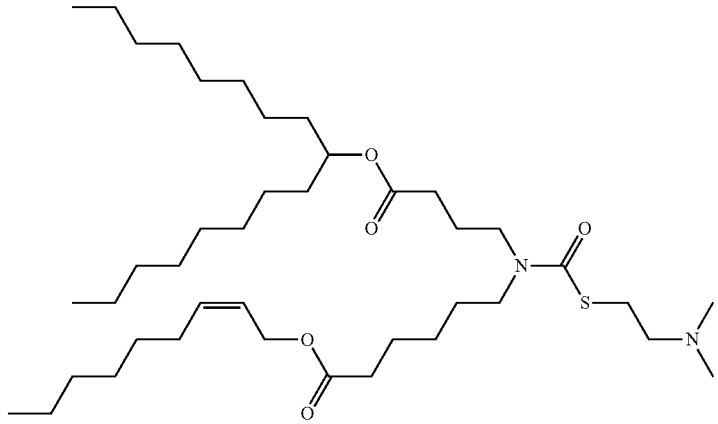 [SMILES: CCCCCC/C=C\COC(=O)CCCCCN(CCCC(=O)OC(CCCCCCCC)CCCCCCCC)C(=O)SCCN(C)C] | 0091 |
| 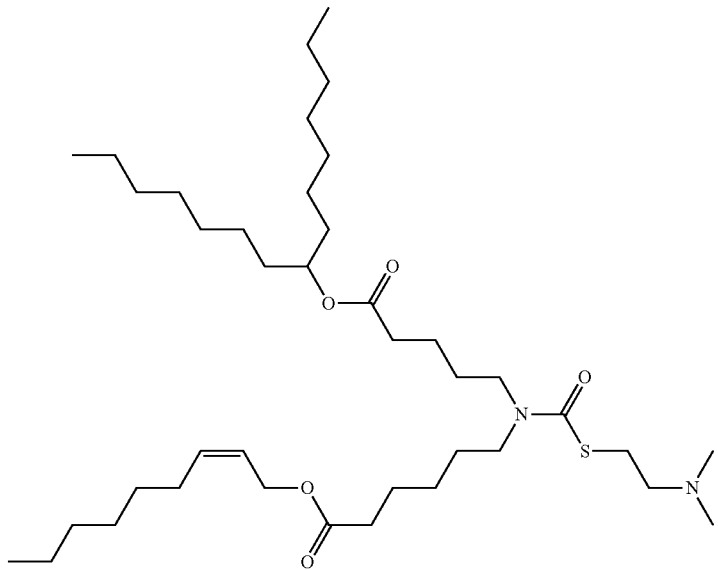 [SMILES: CCCCCC/C=C\COC(=O)CCCCCN(CCCCC(=O)OC(CCCCCCC)CCCCCCC)C(=O)SCCN(C)C] | 0102 |

TABLE 14-continued
| Compound | ATX-# |
|---|---|
| 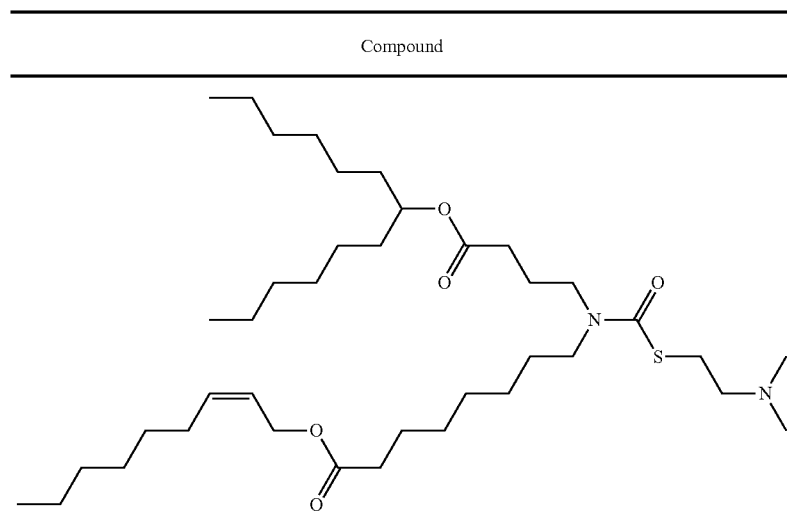 | 0098 |
| 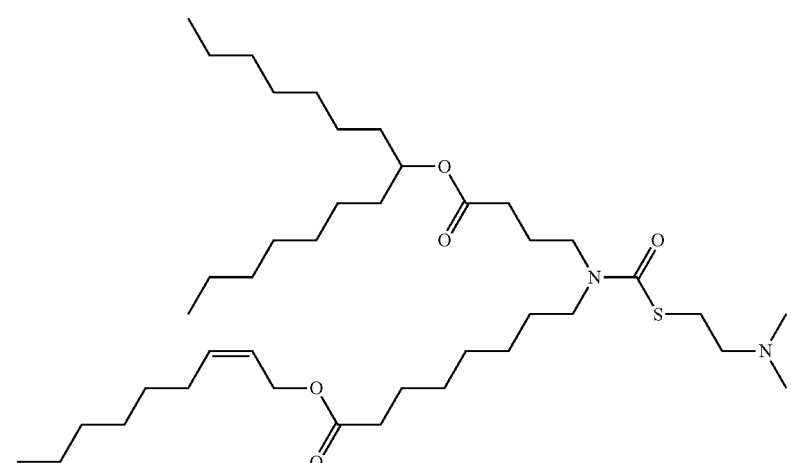 [SMILES: CCCCCC/C=C\COC(=O)CCCCCCCN(CCCC(=O)OC(CCCCCCC)CCCCCCC)C(=O)SCCN(C)C] | 0092 |
| 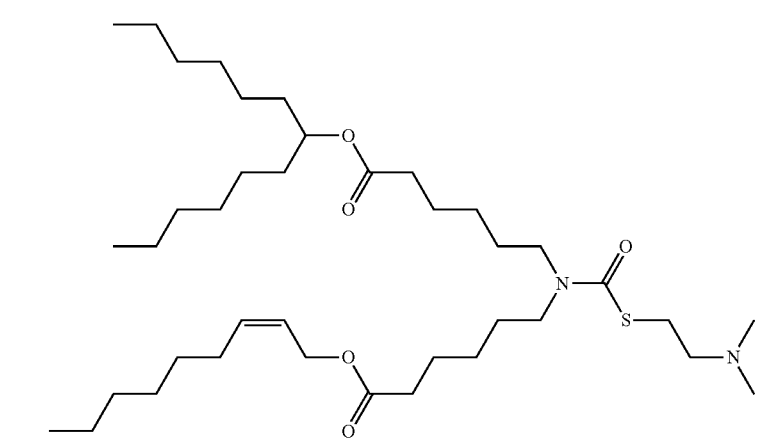 [SMILES: CCCCCC/C=C\COC(=O)CCCCCN(CCCCCC(=O)OC(CCCCCC)CCCCCC)C(=O)SCCN(C)C] | 0084 |

TABLE 14-continued
| Compound | ATX-# |
|---|---|
| 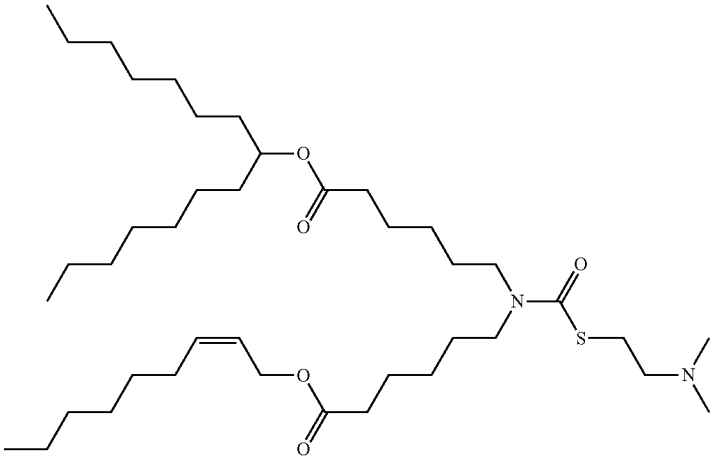 [SMILES: CCCCCC/C=C\COC(=O)CCCCCN(CCCCCC(=O)OC(CCCCCCC)CCCCCCC)C(=O)SCCN(C)C] | 0095 |
| 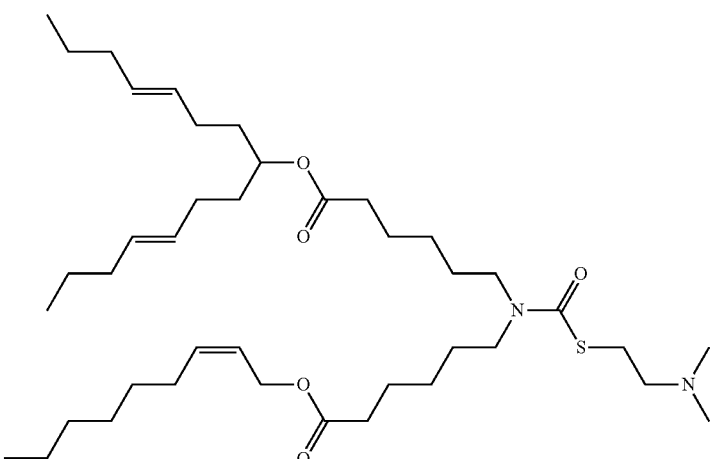 | 0125 |
| 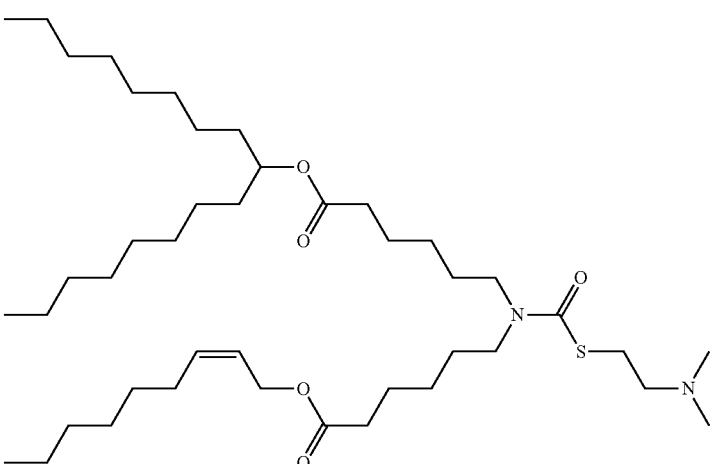 | 0094 |

TABLE 14-continued
| Compound | ATX-# |
|---|---|
| 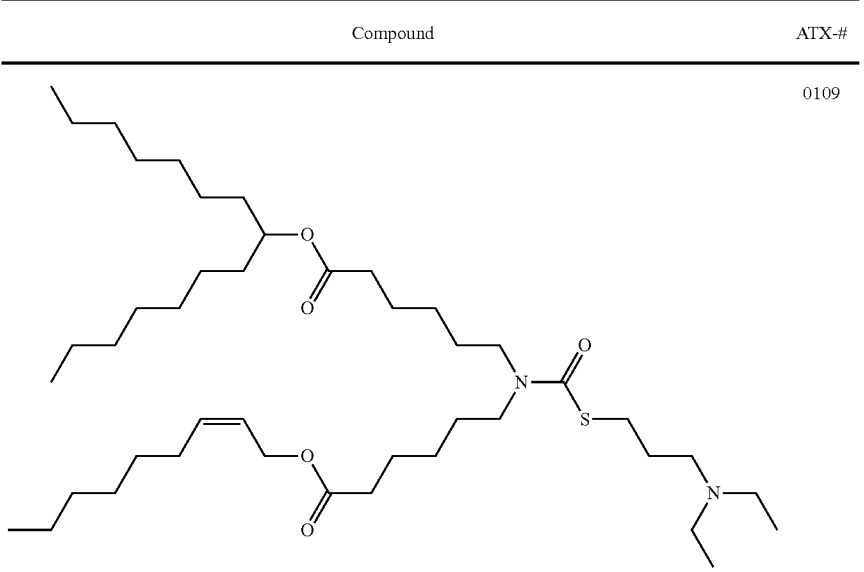 | 0109 |
| 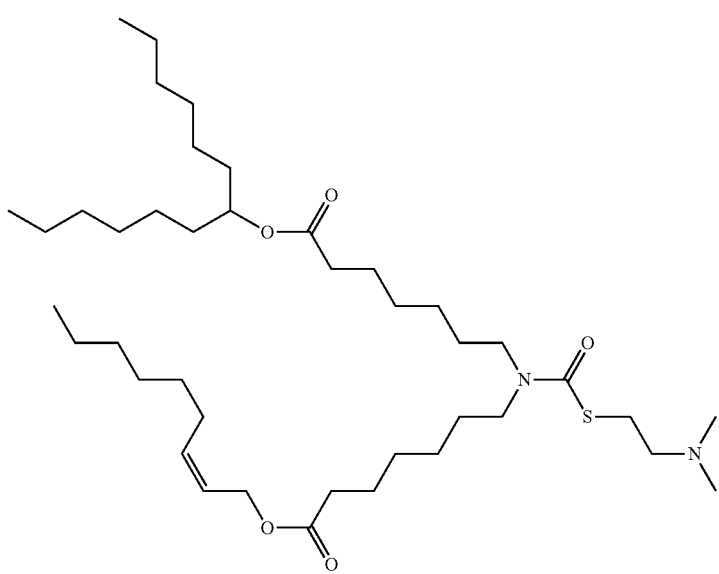 [SMILES: CCCCCC/C=C\COC(=O)CCCCCCN(CCCCCCC(=O)OC(CCCCCC)CCCCCC)C(=O)SCCN(C)C] | 0110 |

TABLE 14-continued
| Compound | ATX-# |
|---|---|
| 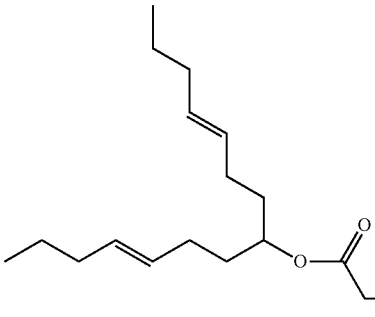 | 0118 |
| 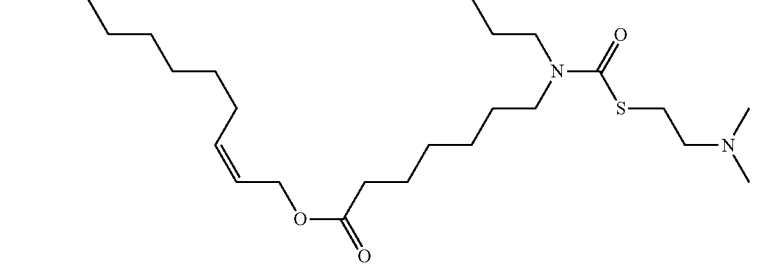 | 0108 |
| 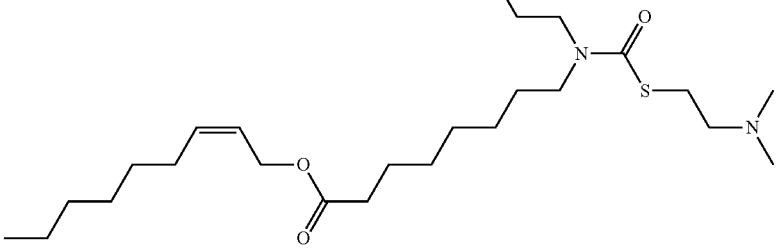 | 0107 |

TABLE 14-continued

| Compound | ATX-# |
|---|---|
| | 0093 |
| | 0097 |
| | 0096 |

TABLE 15a
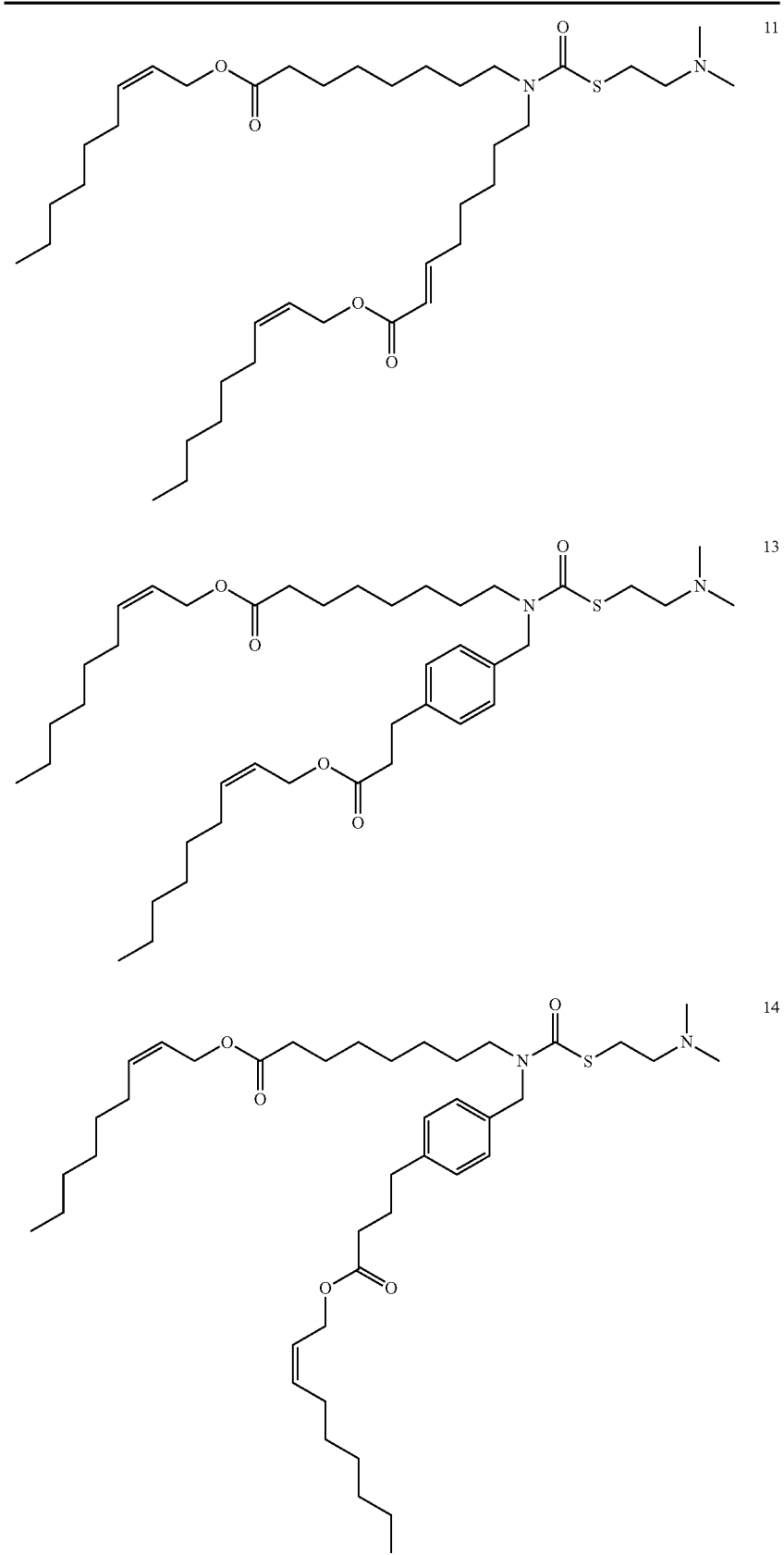

TABLE 15a-continued
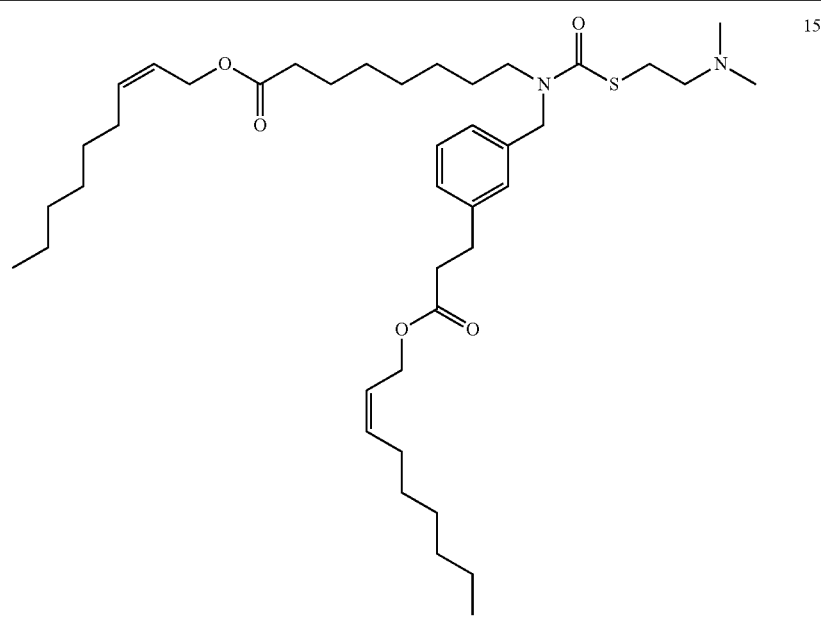
15
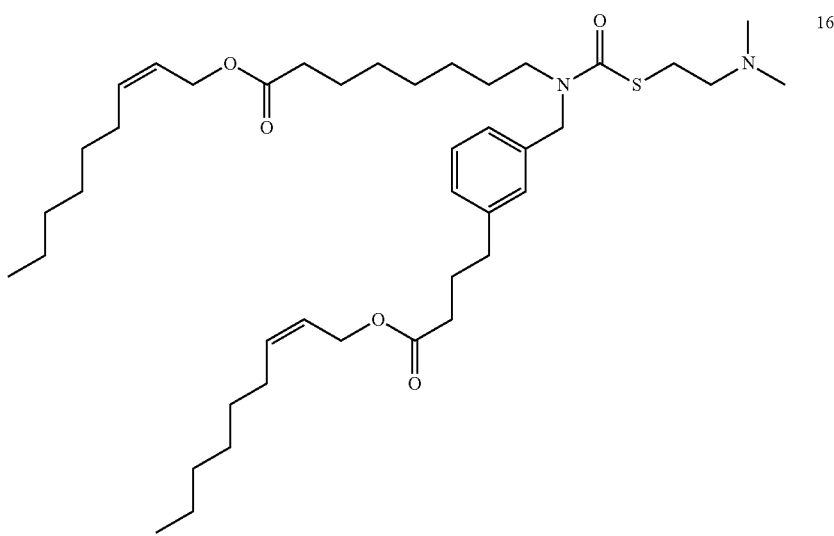
16
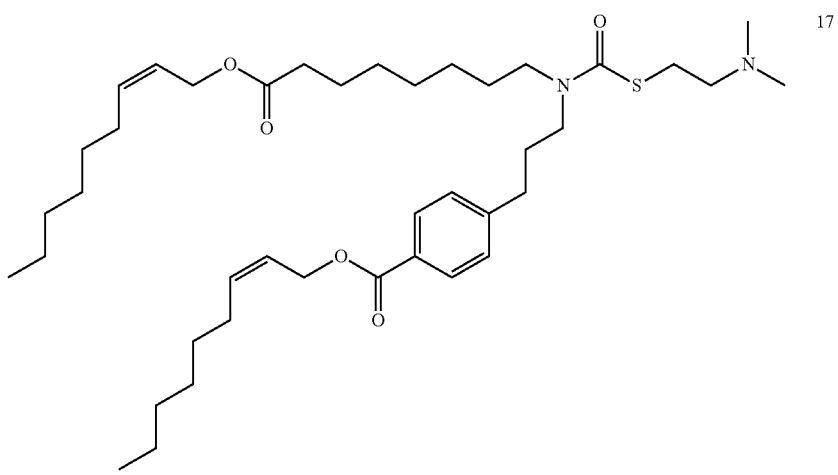
17

TABLE 15a-continued
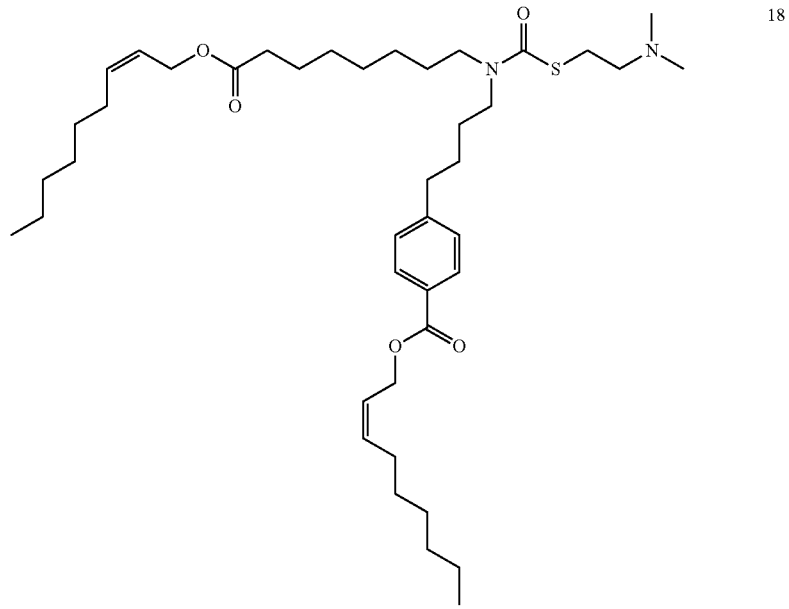
18
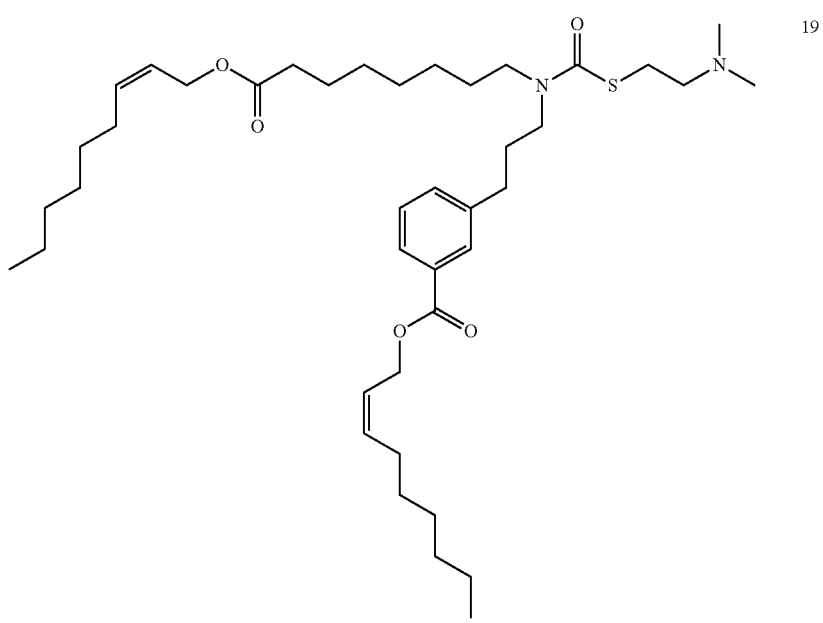
19

TABLE 15a-continued
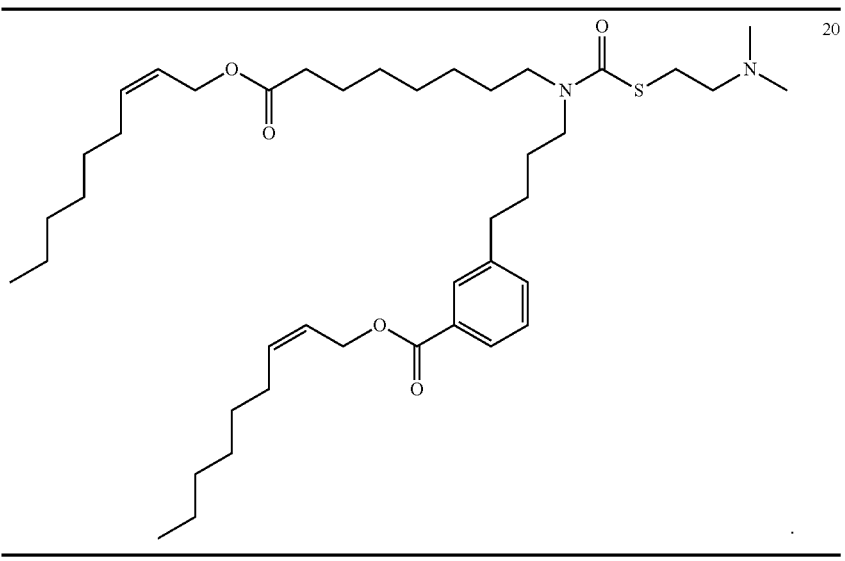
20
In some embodiments, an ionizable lipid is as described in international patent application PCT/US2019/015913. In some embodiments, an ionizable lipid is chosen from the following:
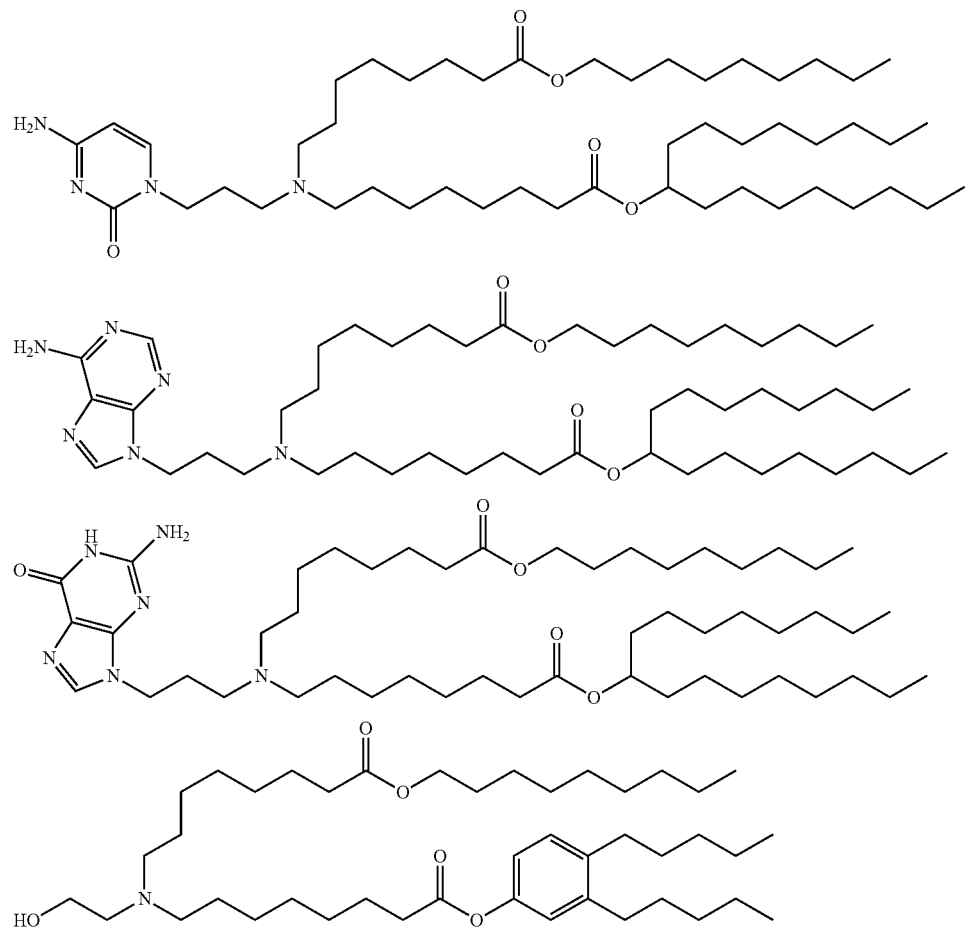

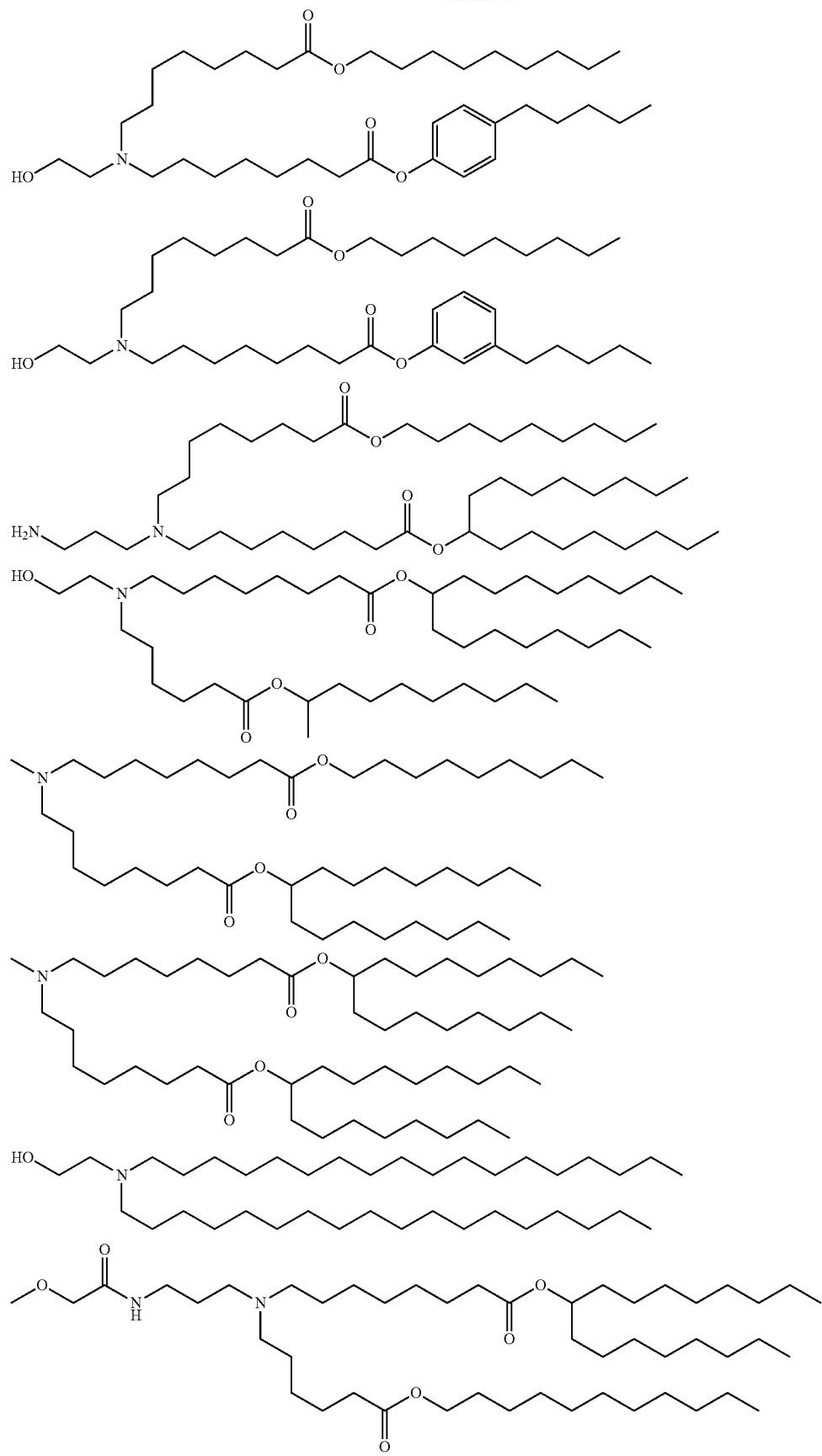

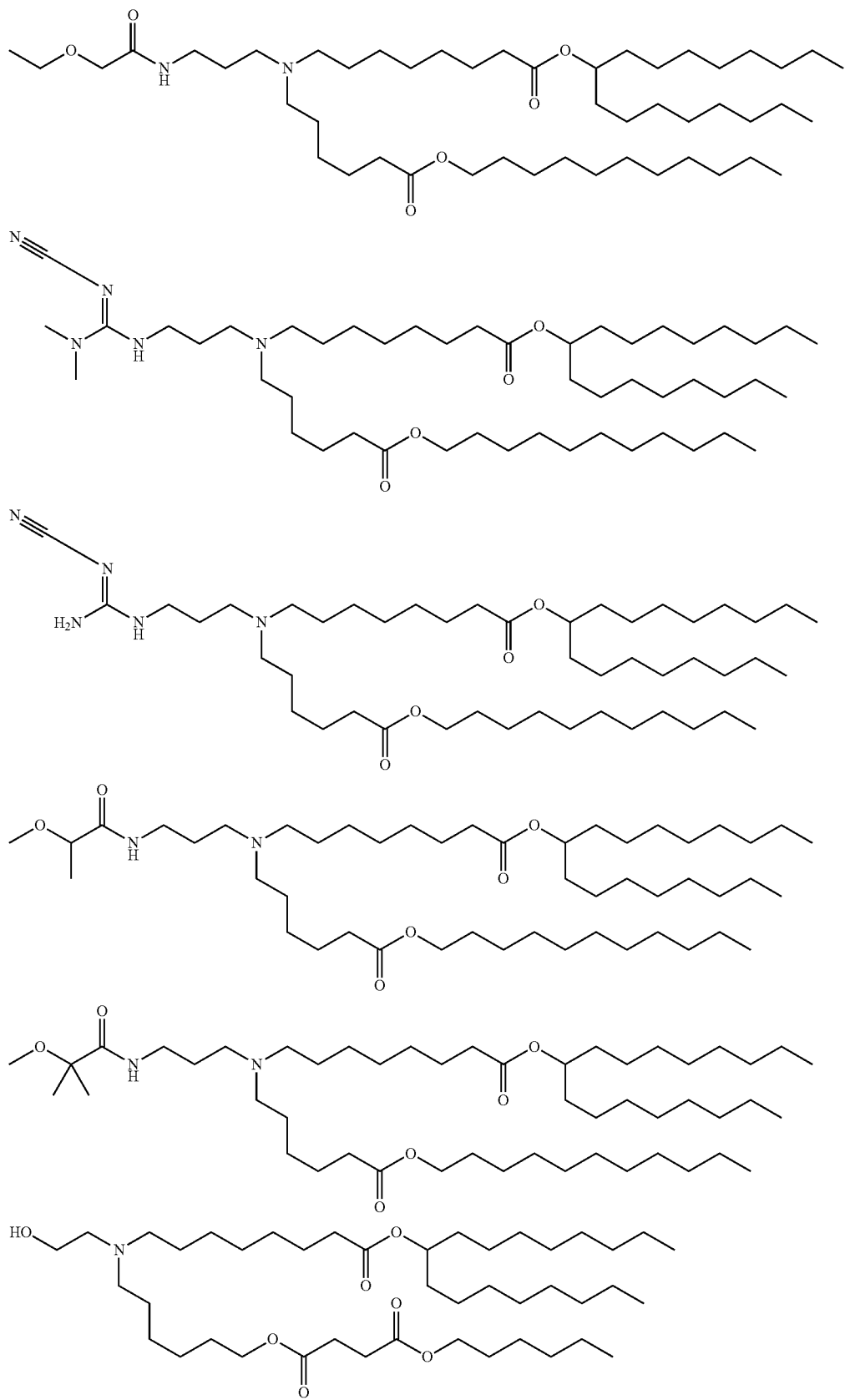

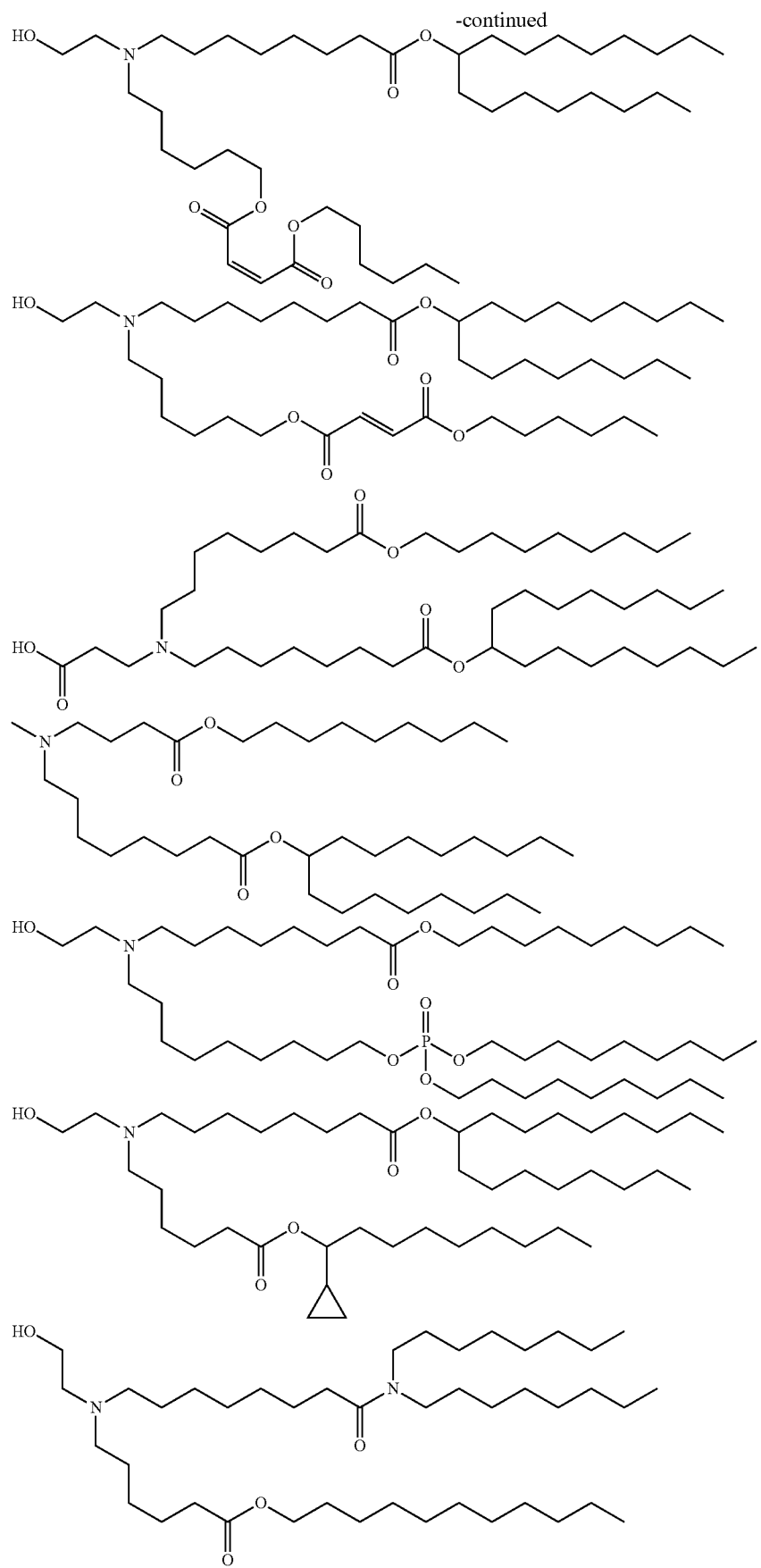

-continued
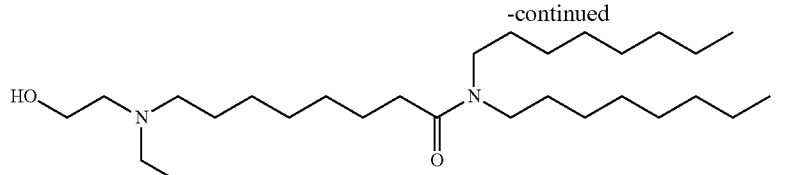
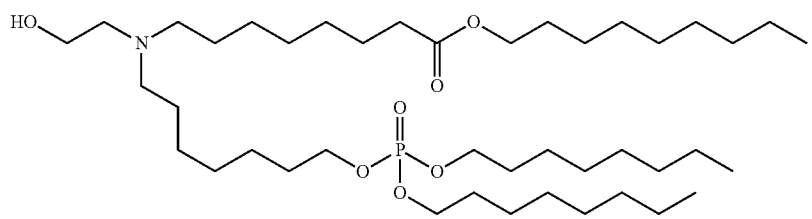
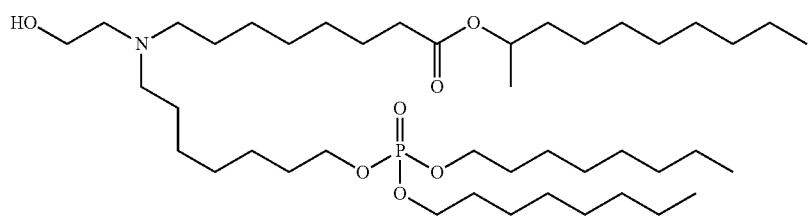
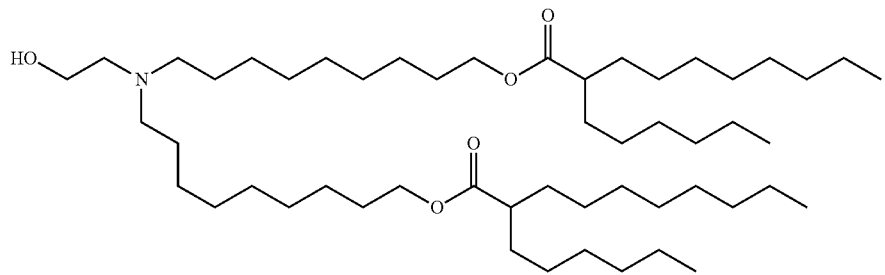
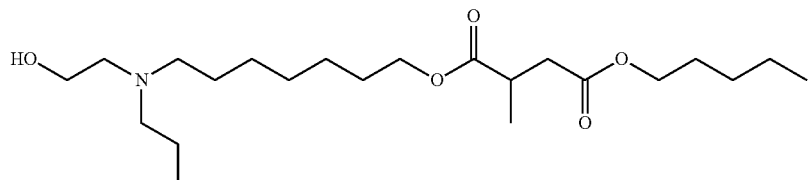
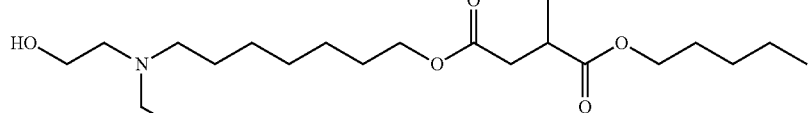
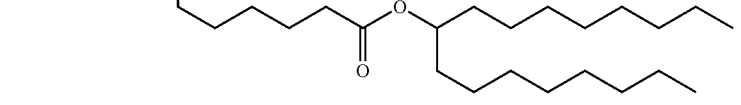

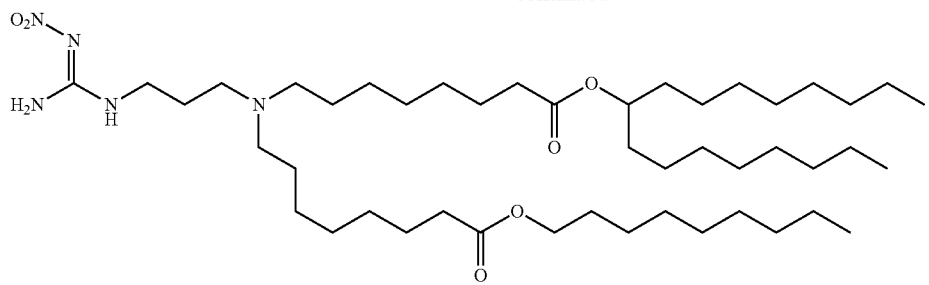
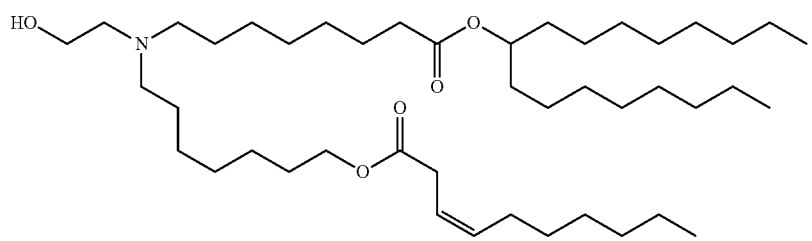
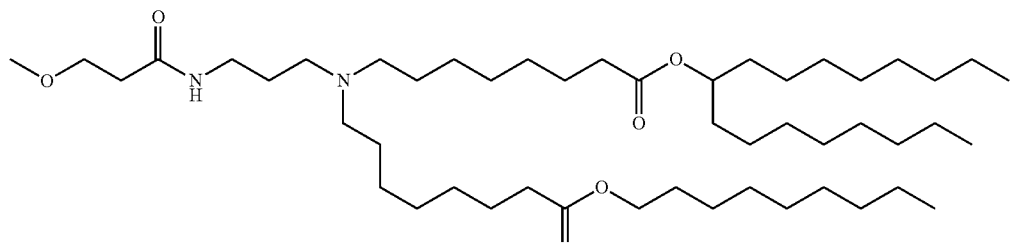
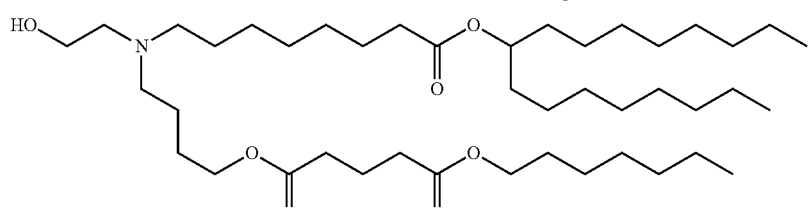
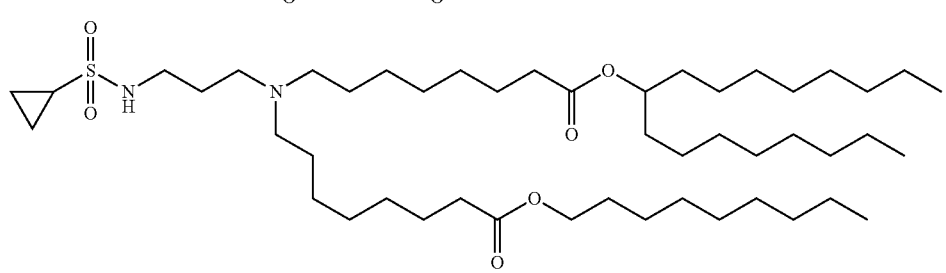
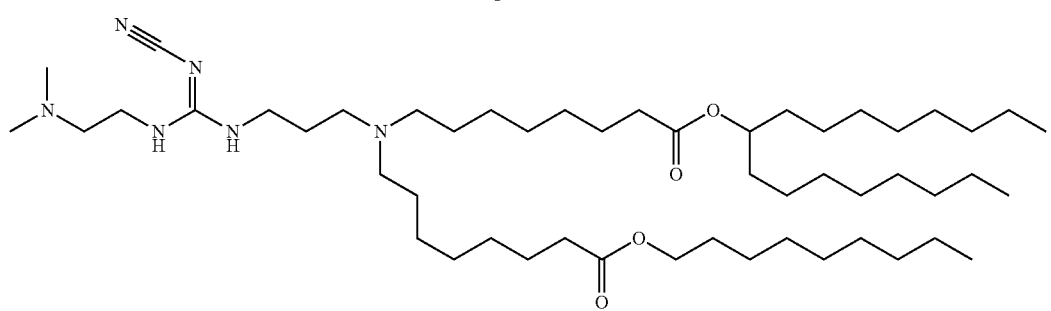

-continued
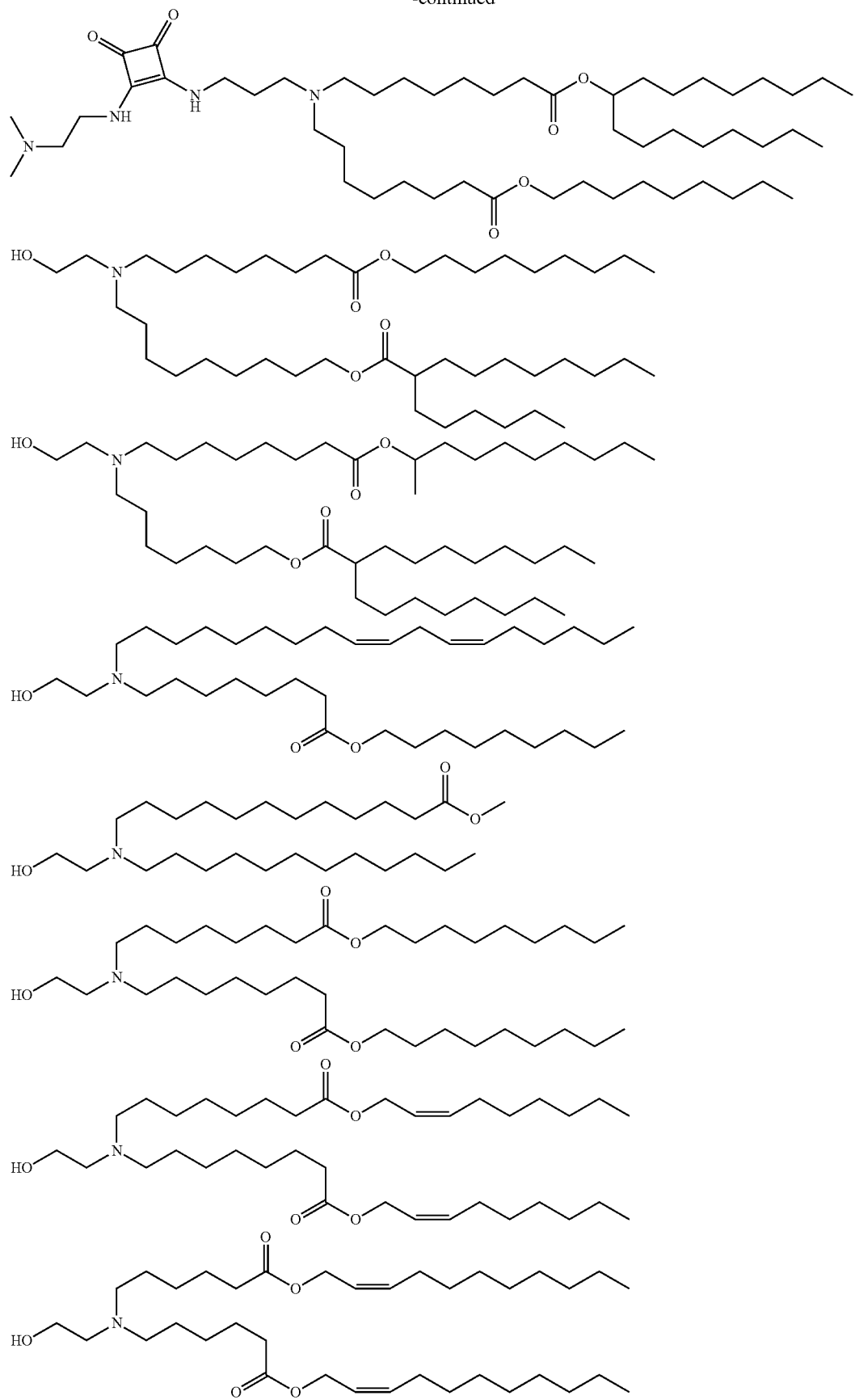

-continued
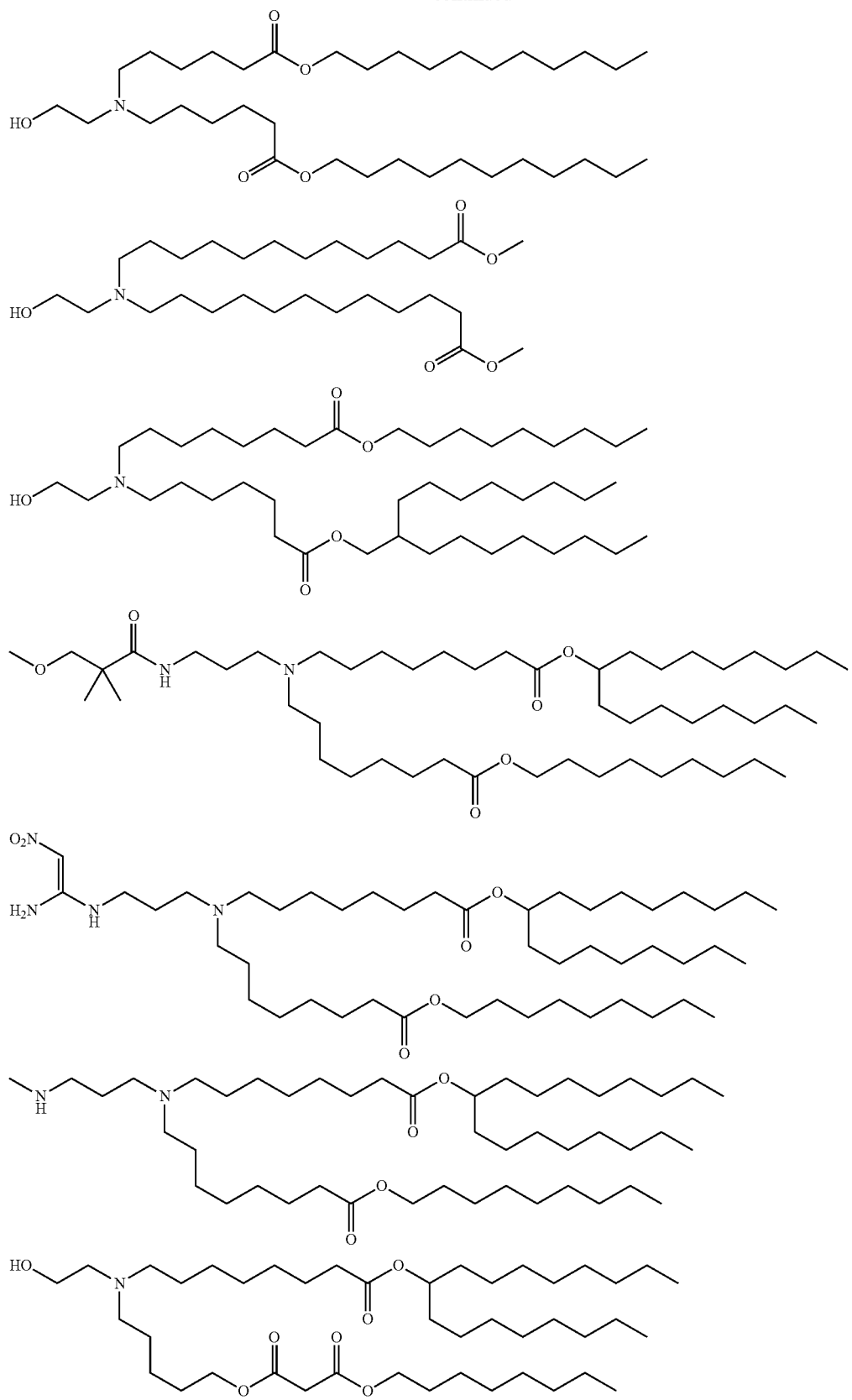

605
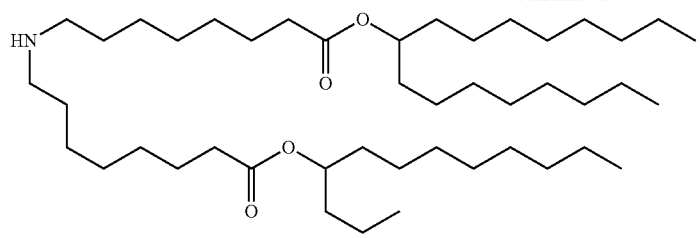
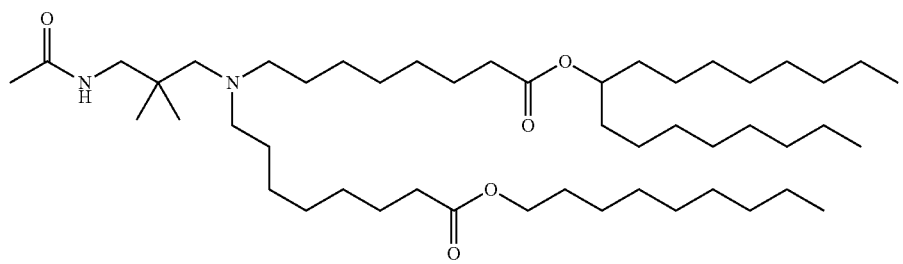
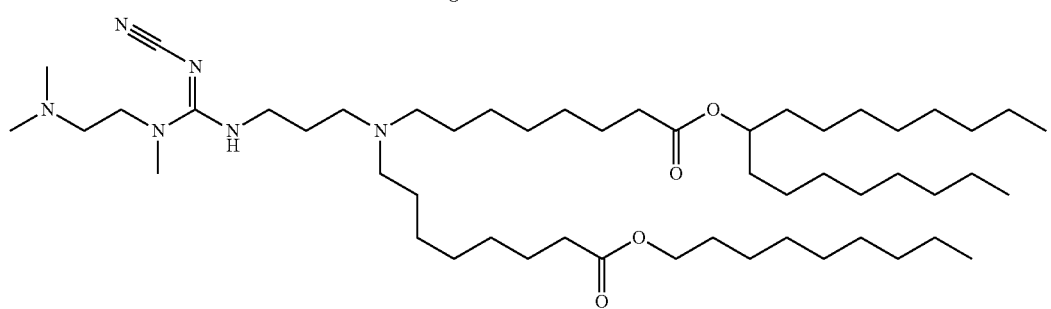
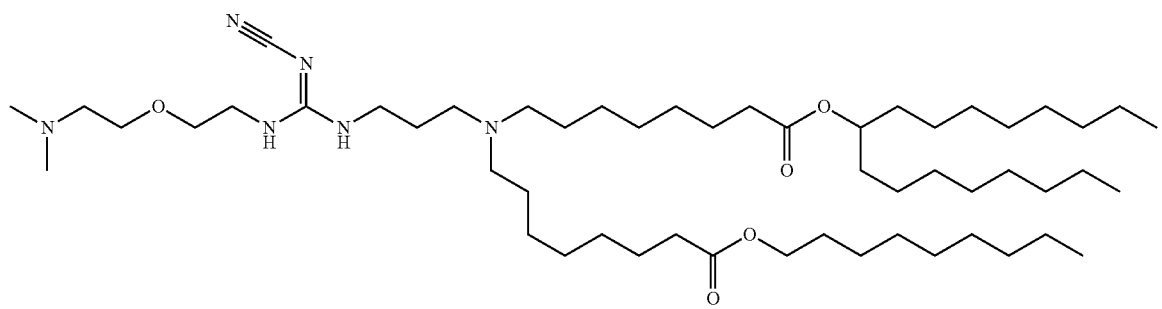
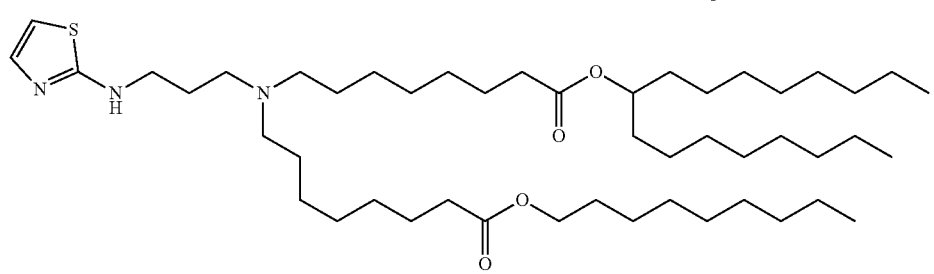
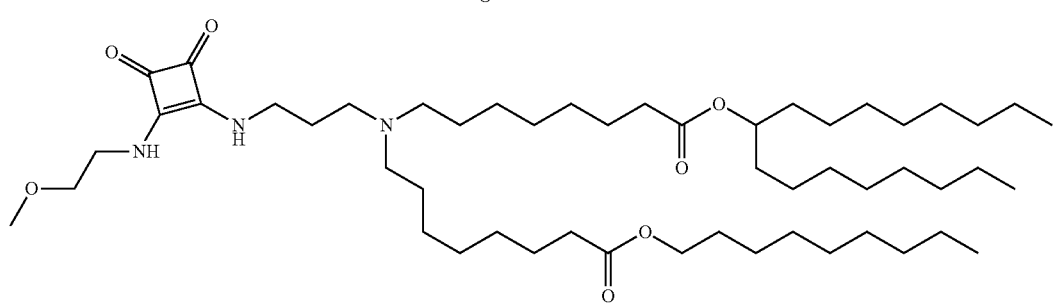

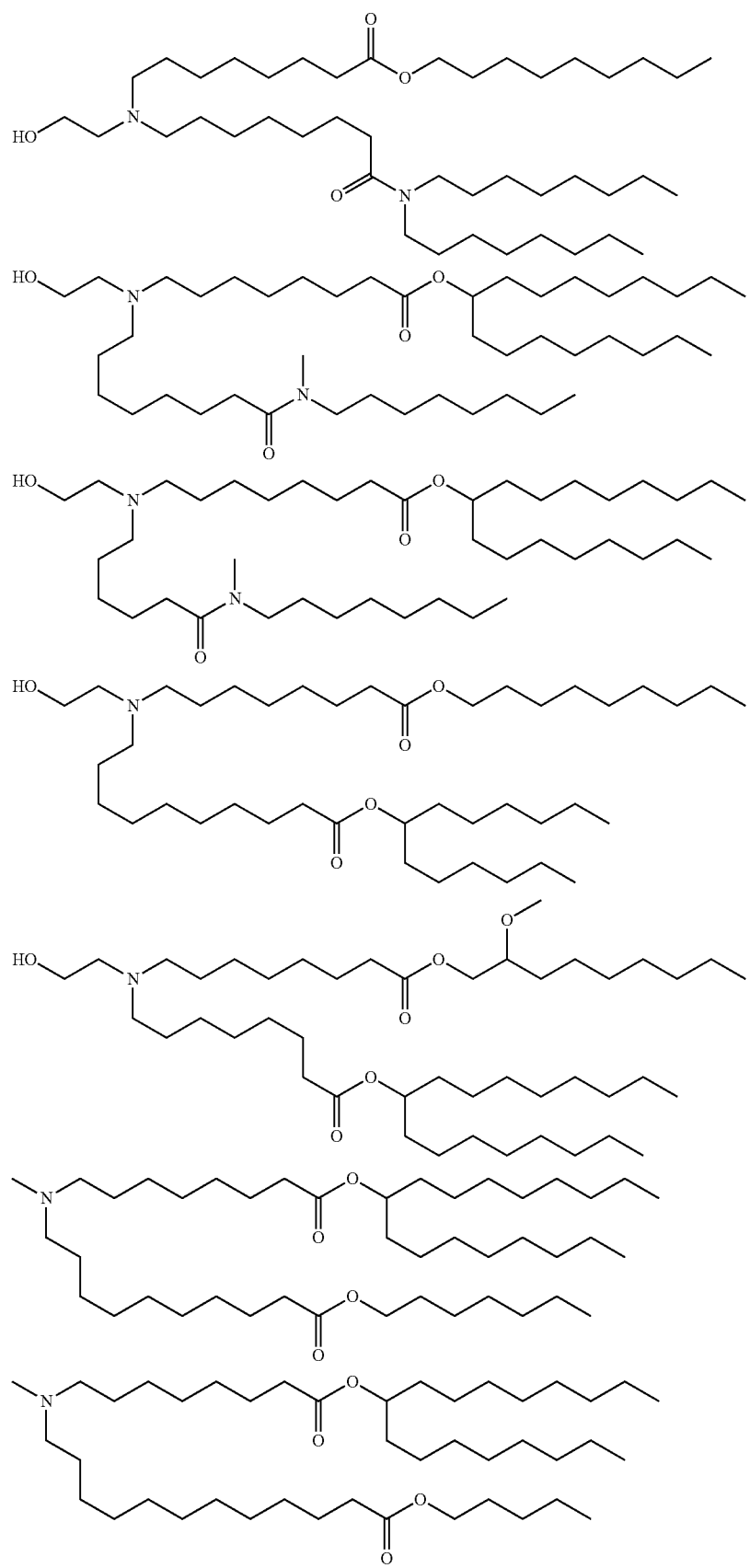

-continued
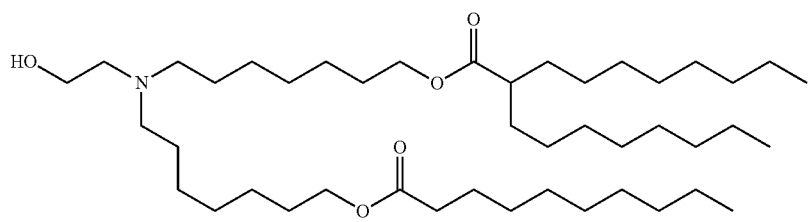
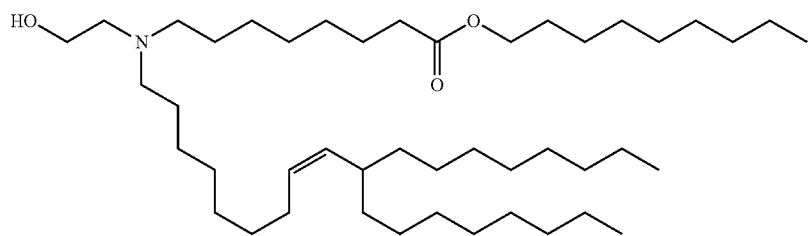
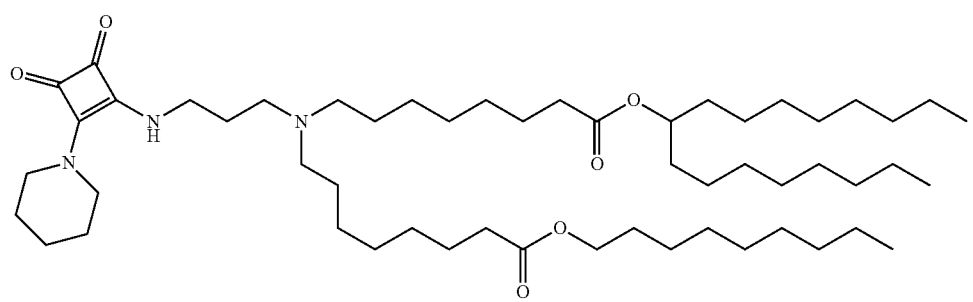
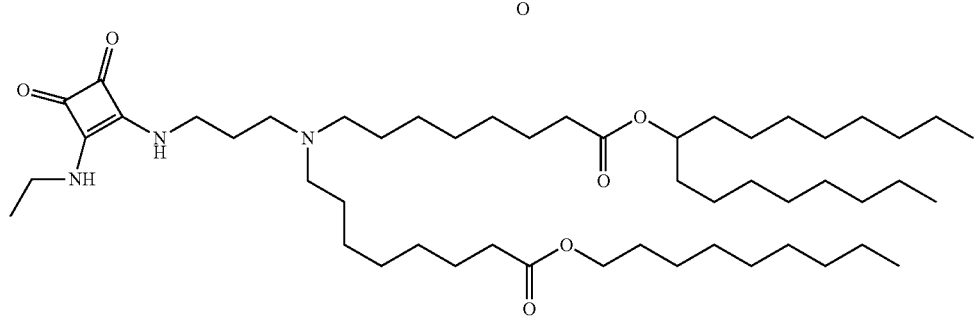
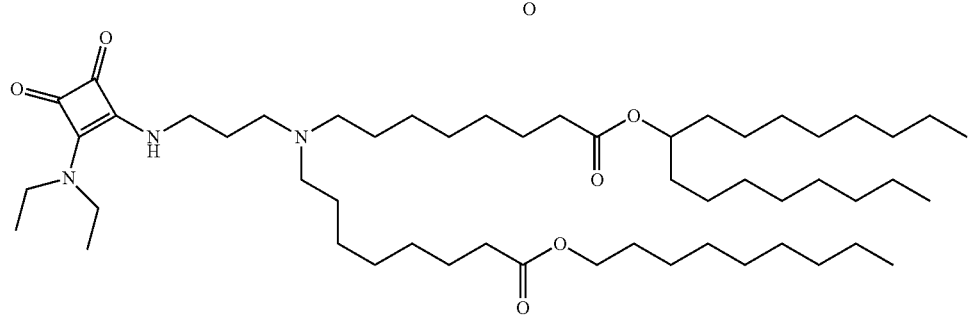
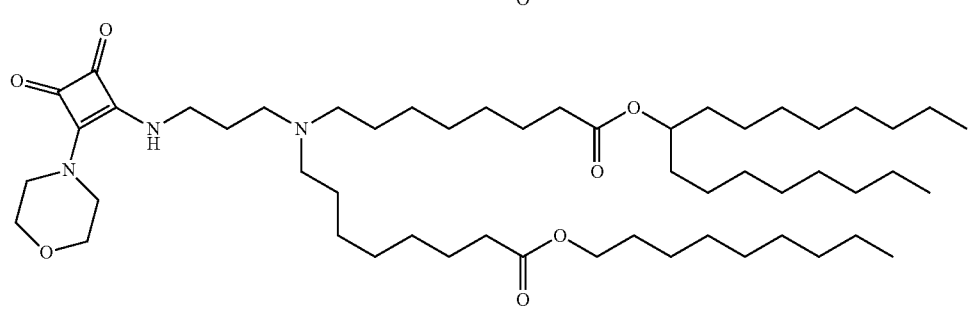

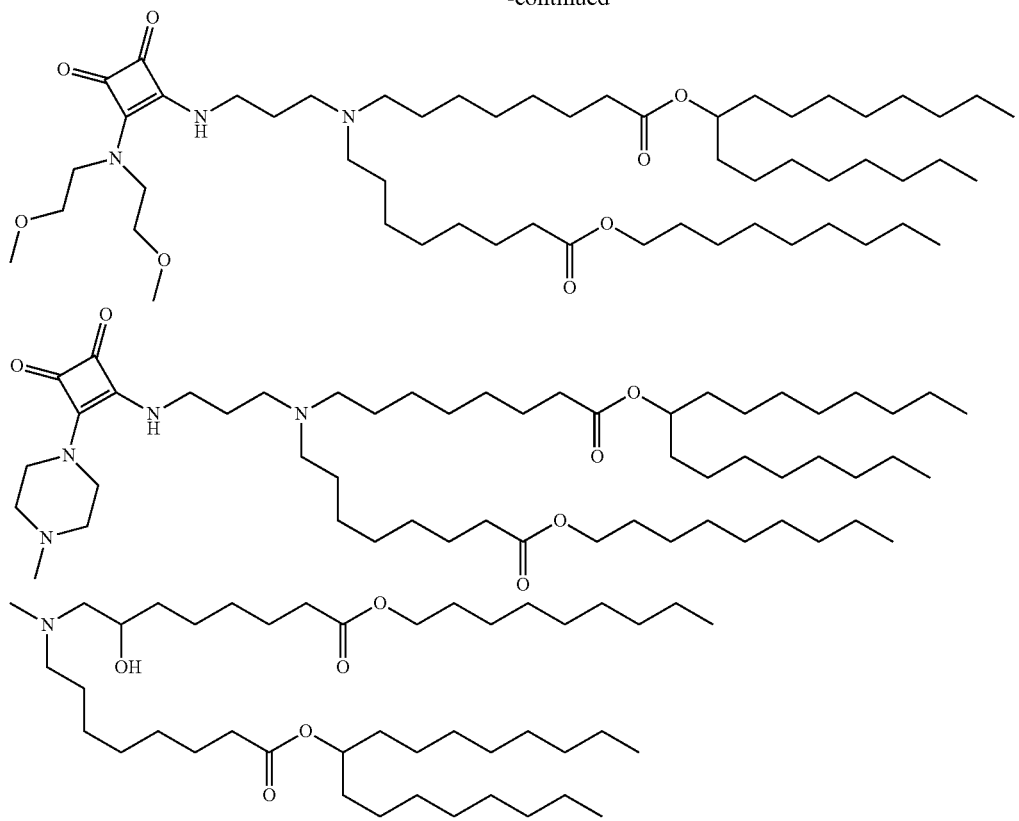
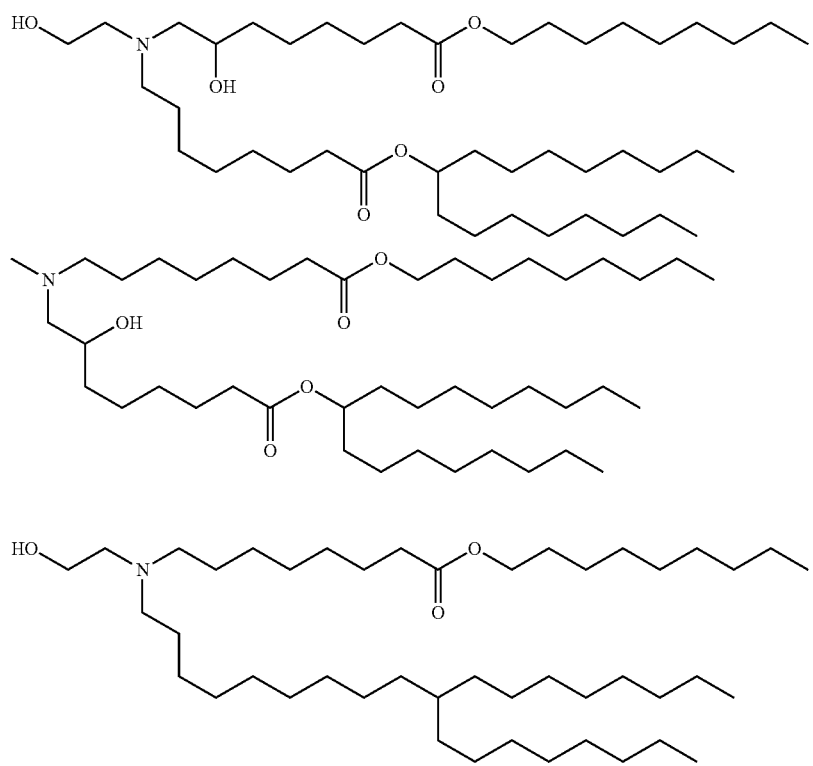

-continued
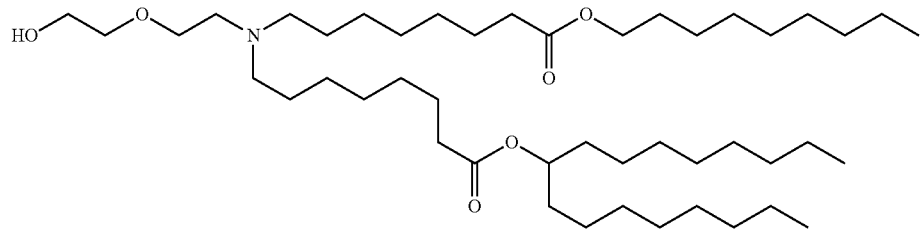
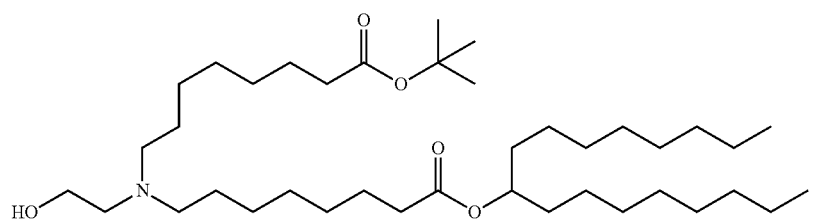
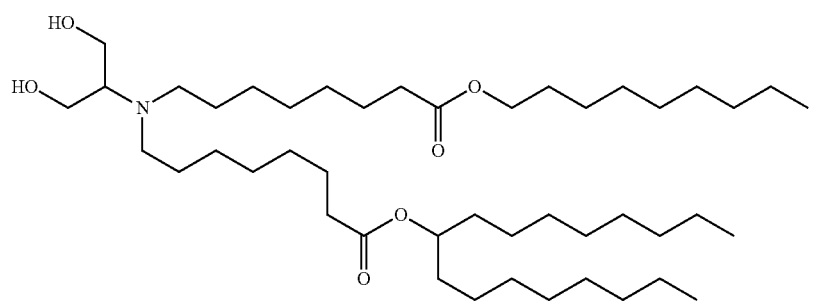
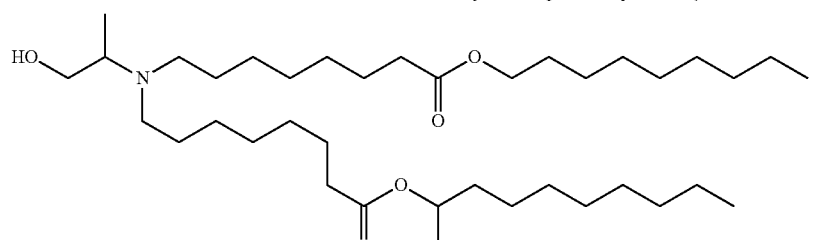
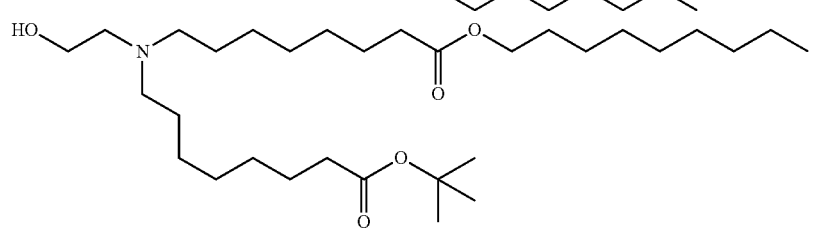
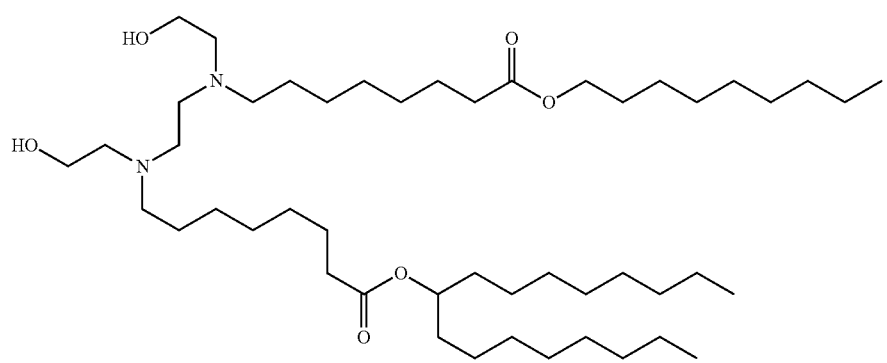

-continued
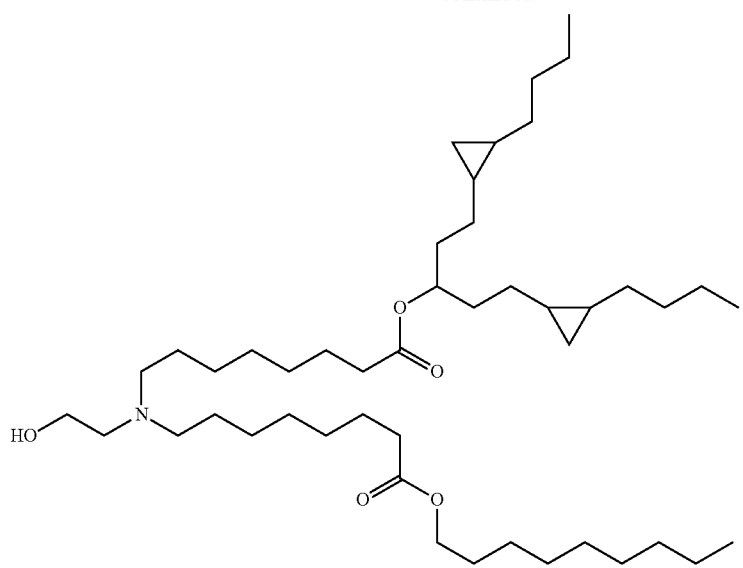
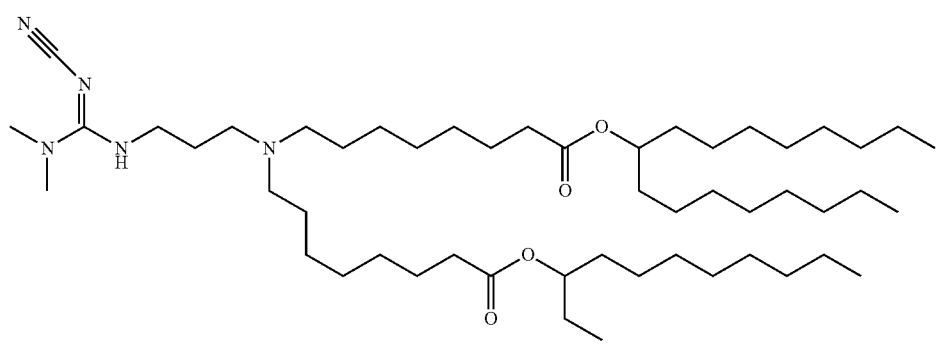
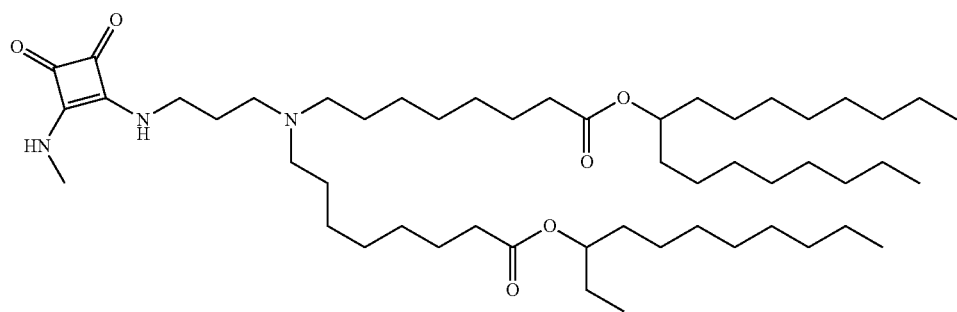
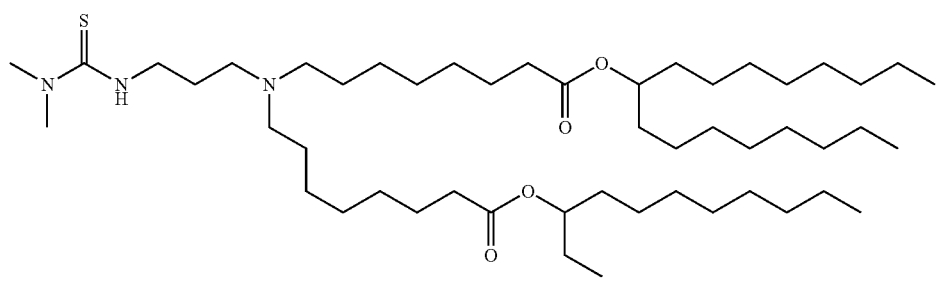

-continued
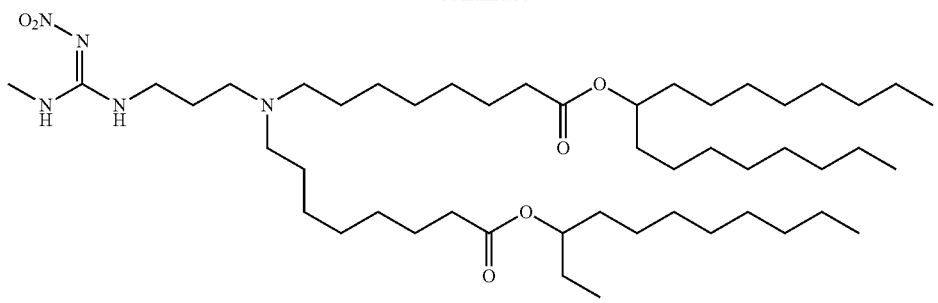
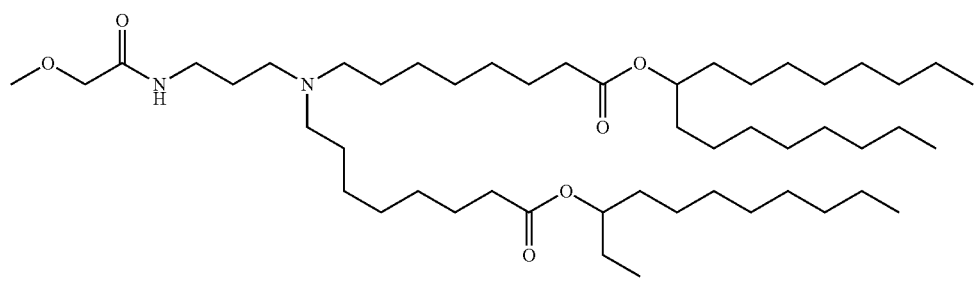
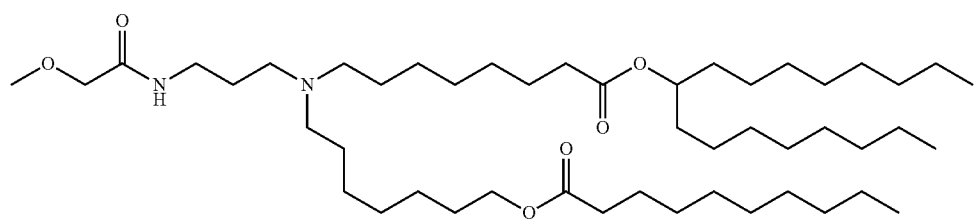
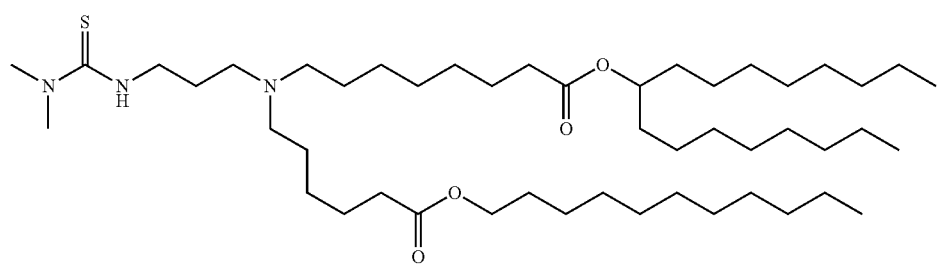
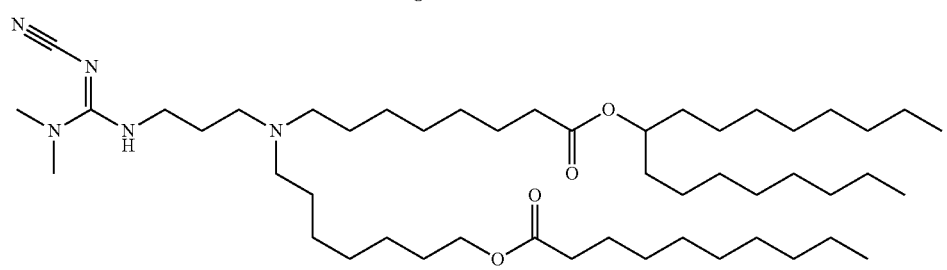
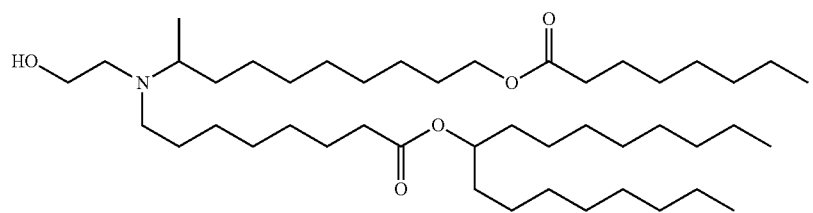

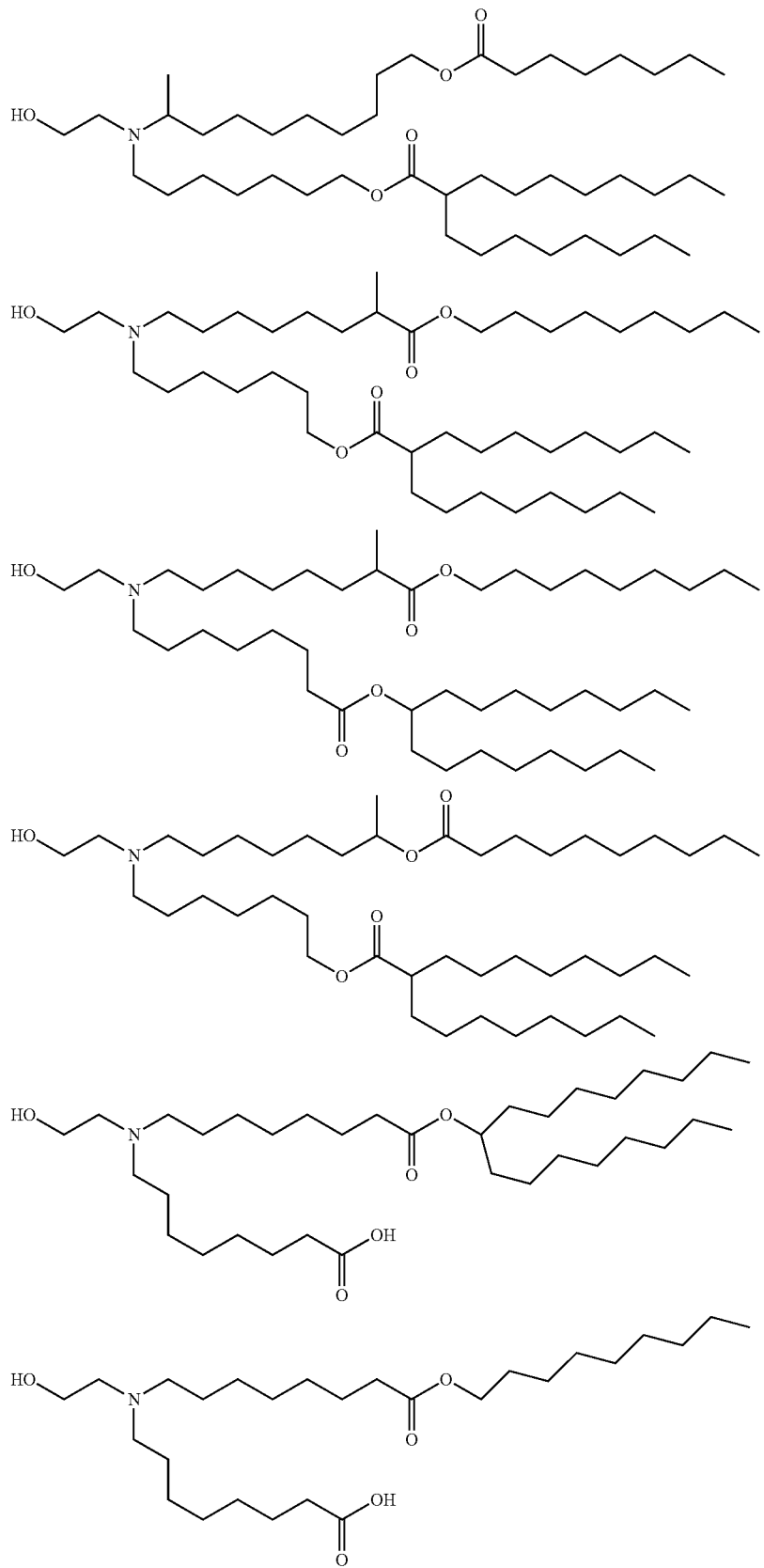

-continued
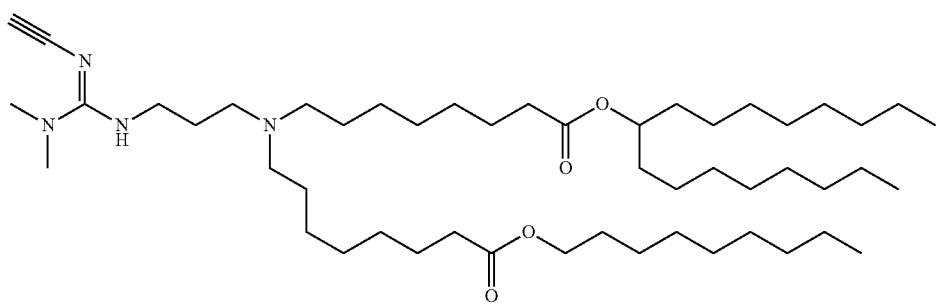
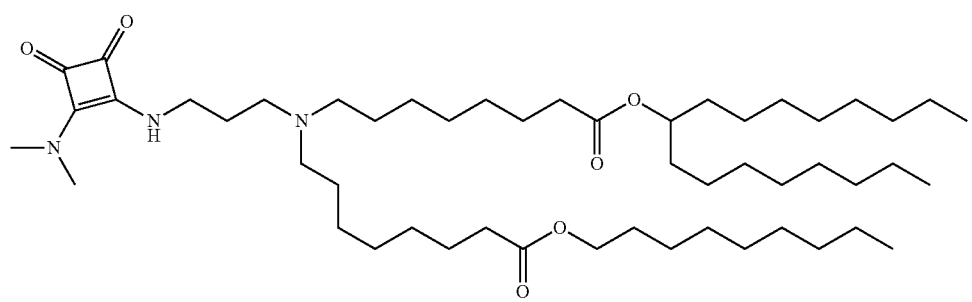
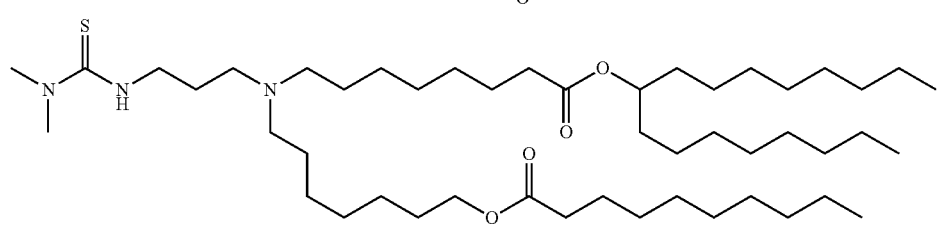
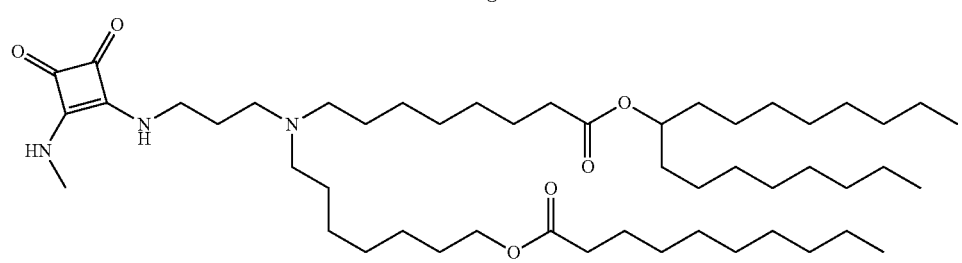
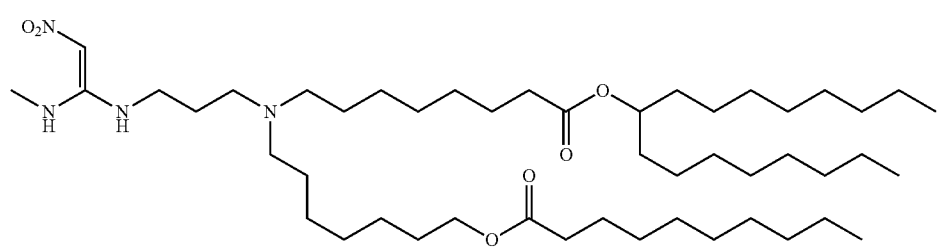
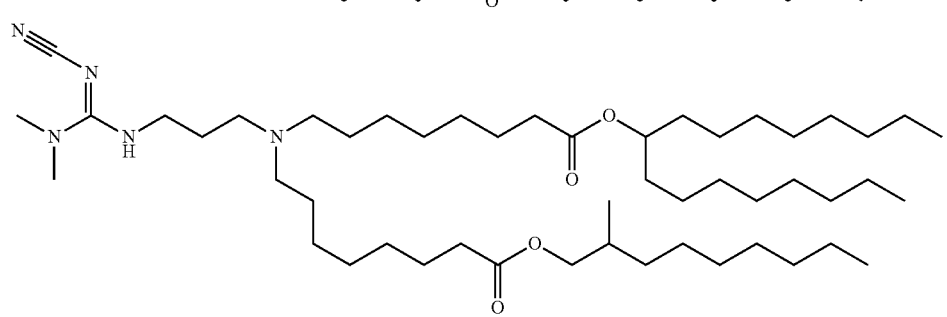

-continued
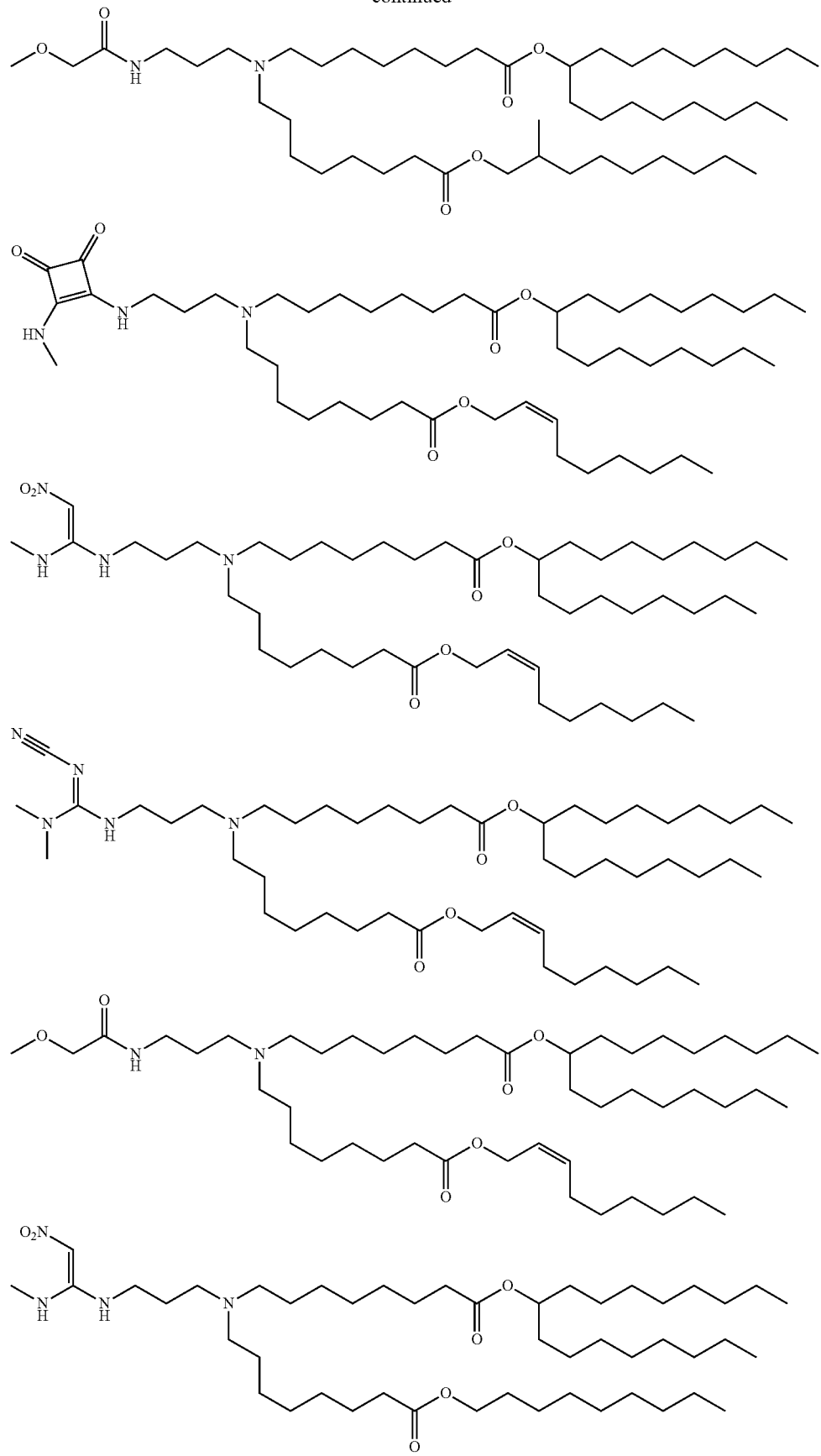

-continued
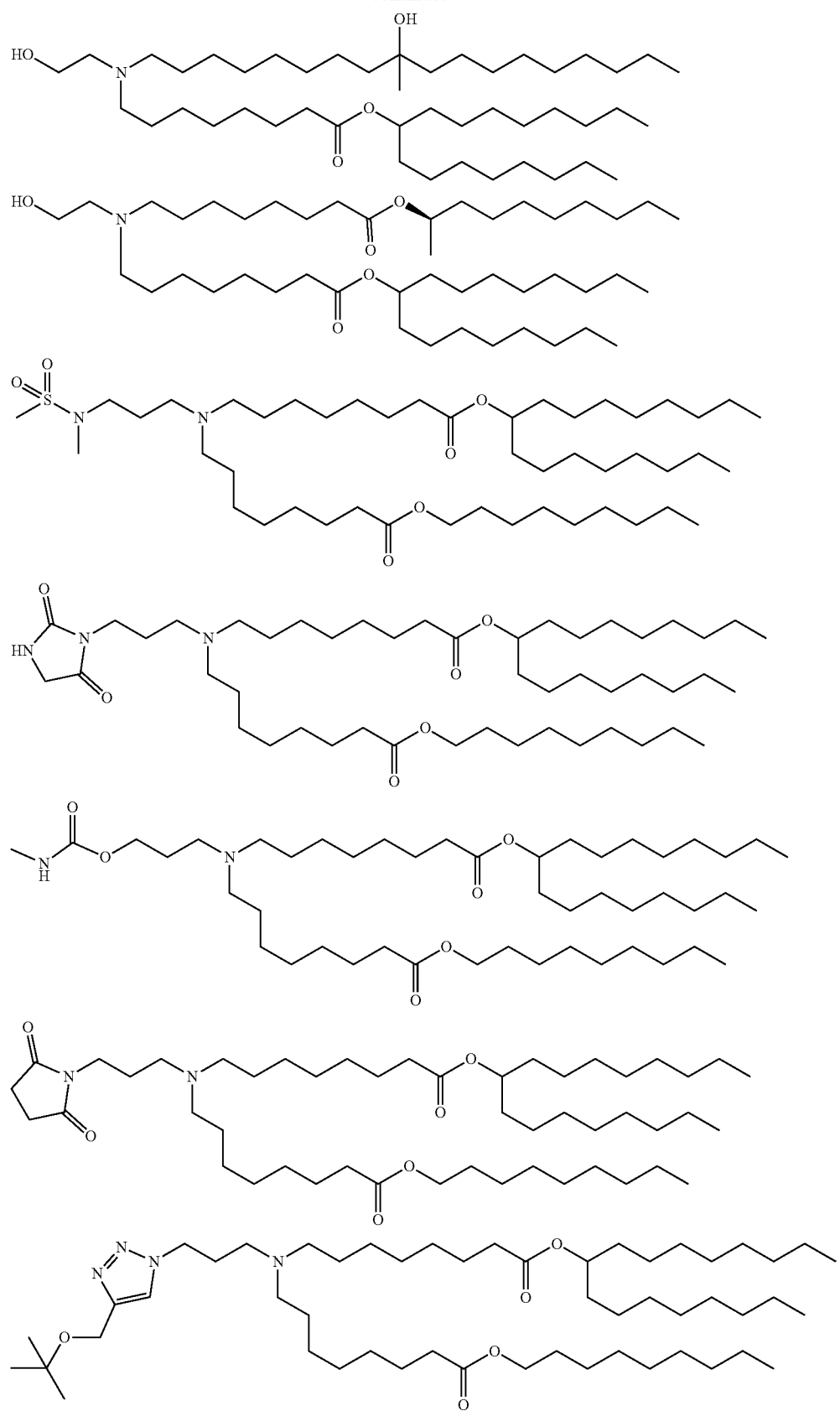

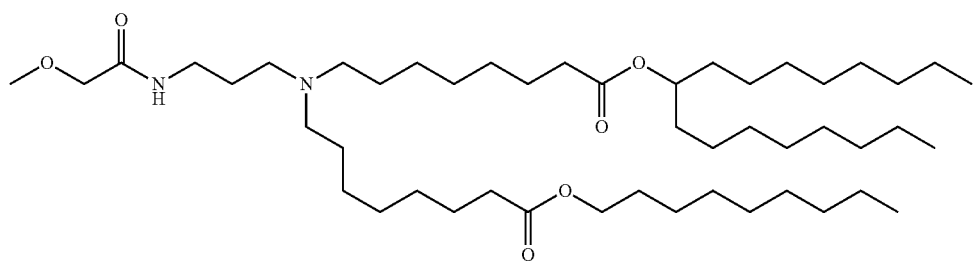
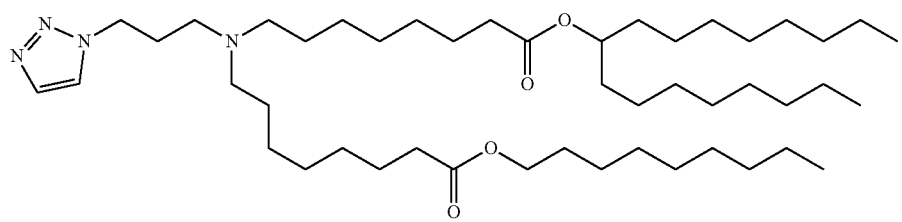
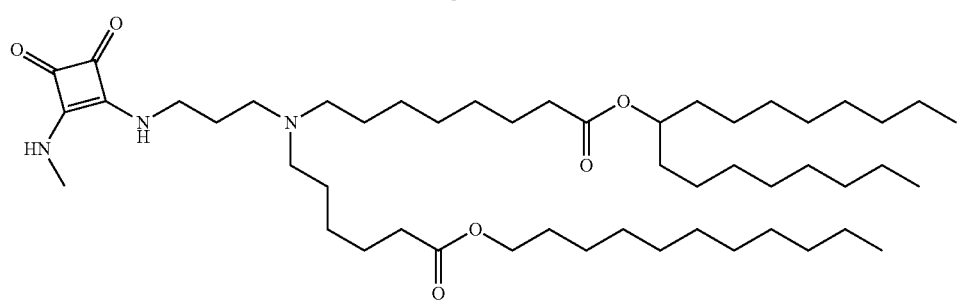
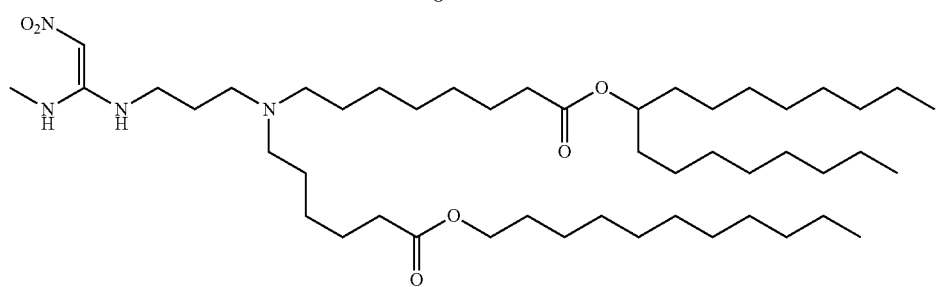
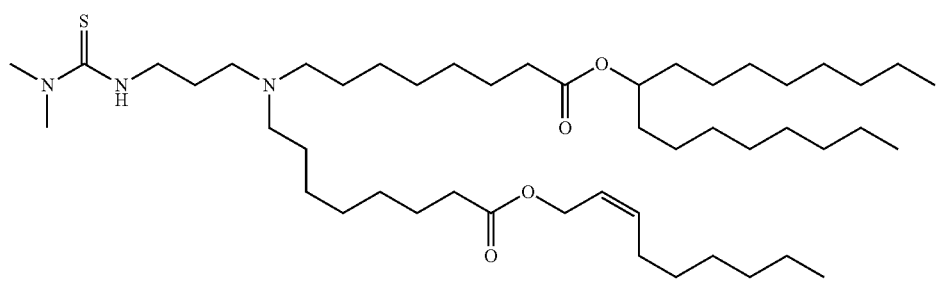
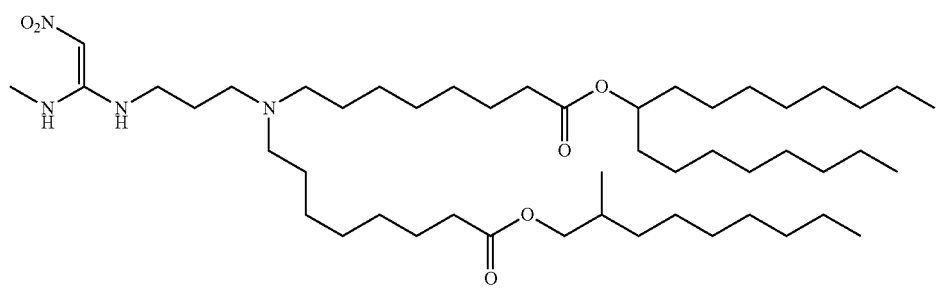

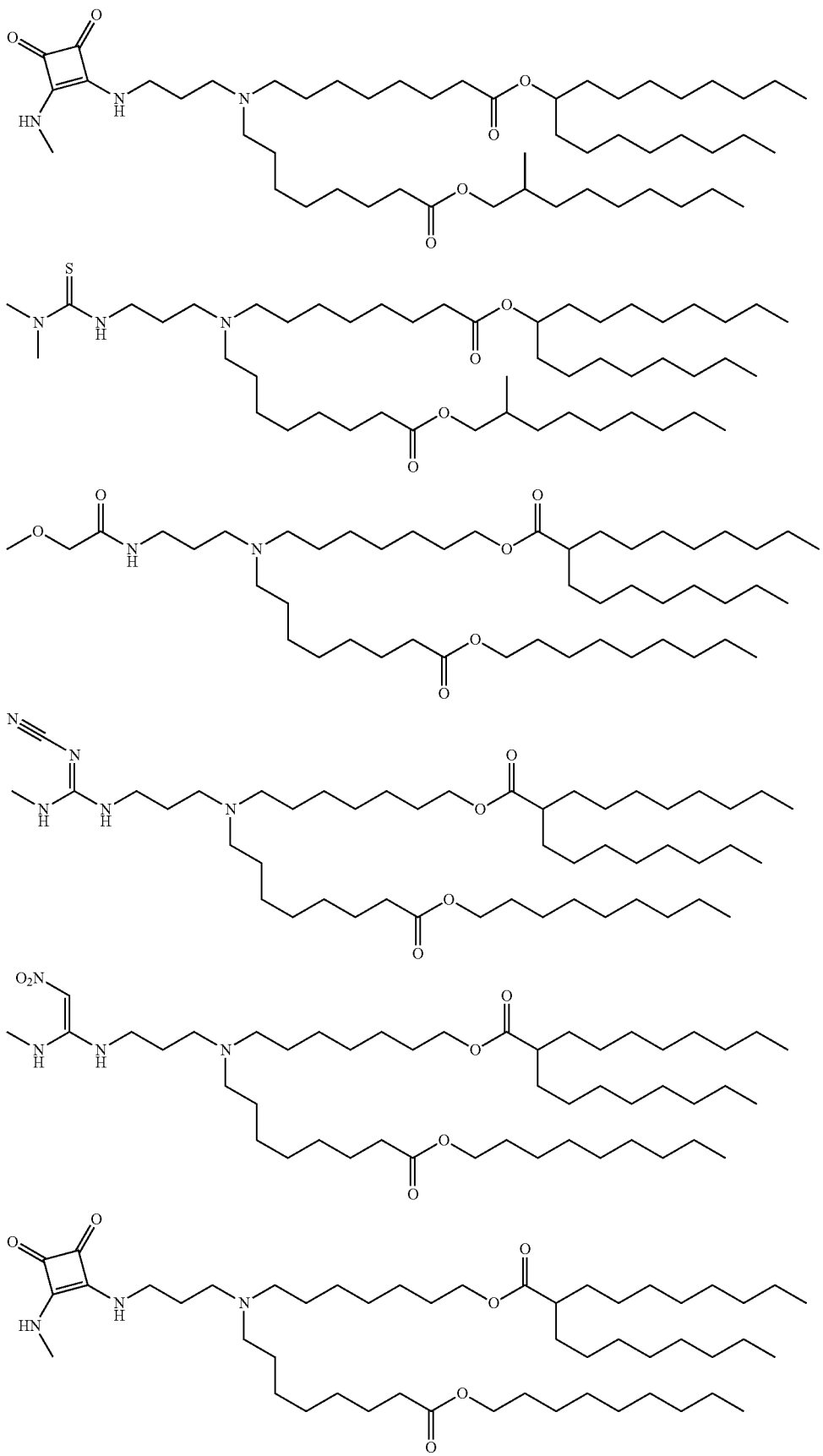

-continued
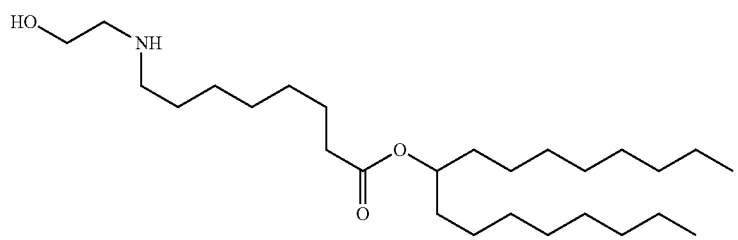
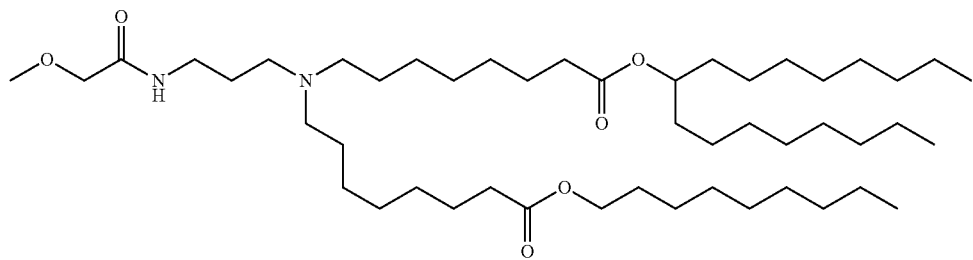
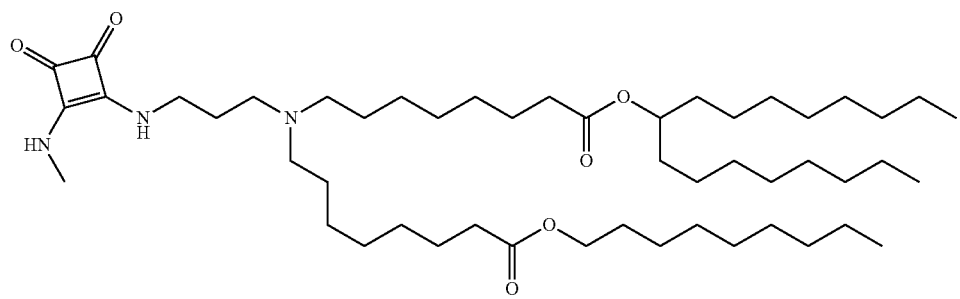
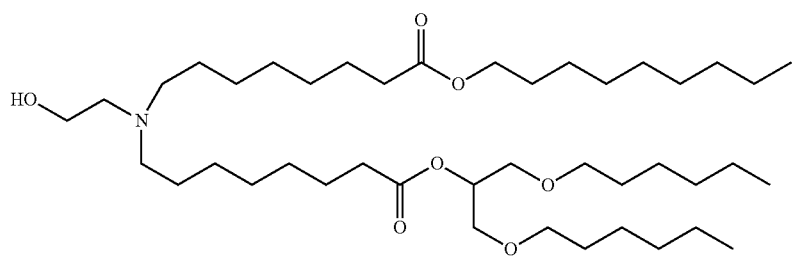
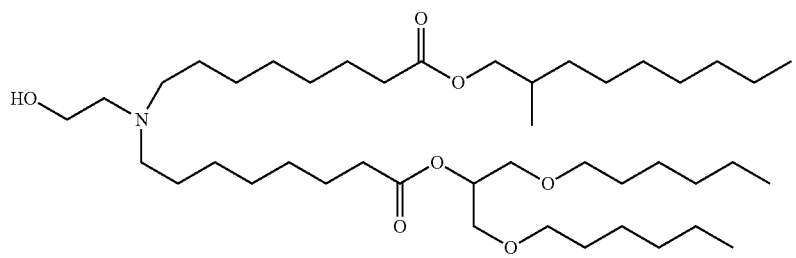
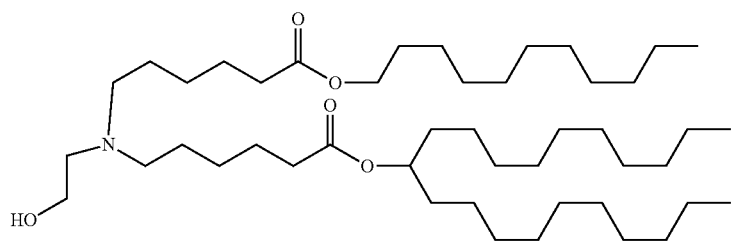

-continued
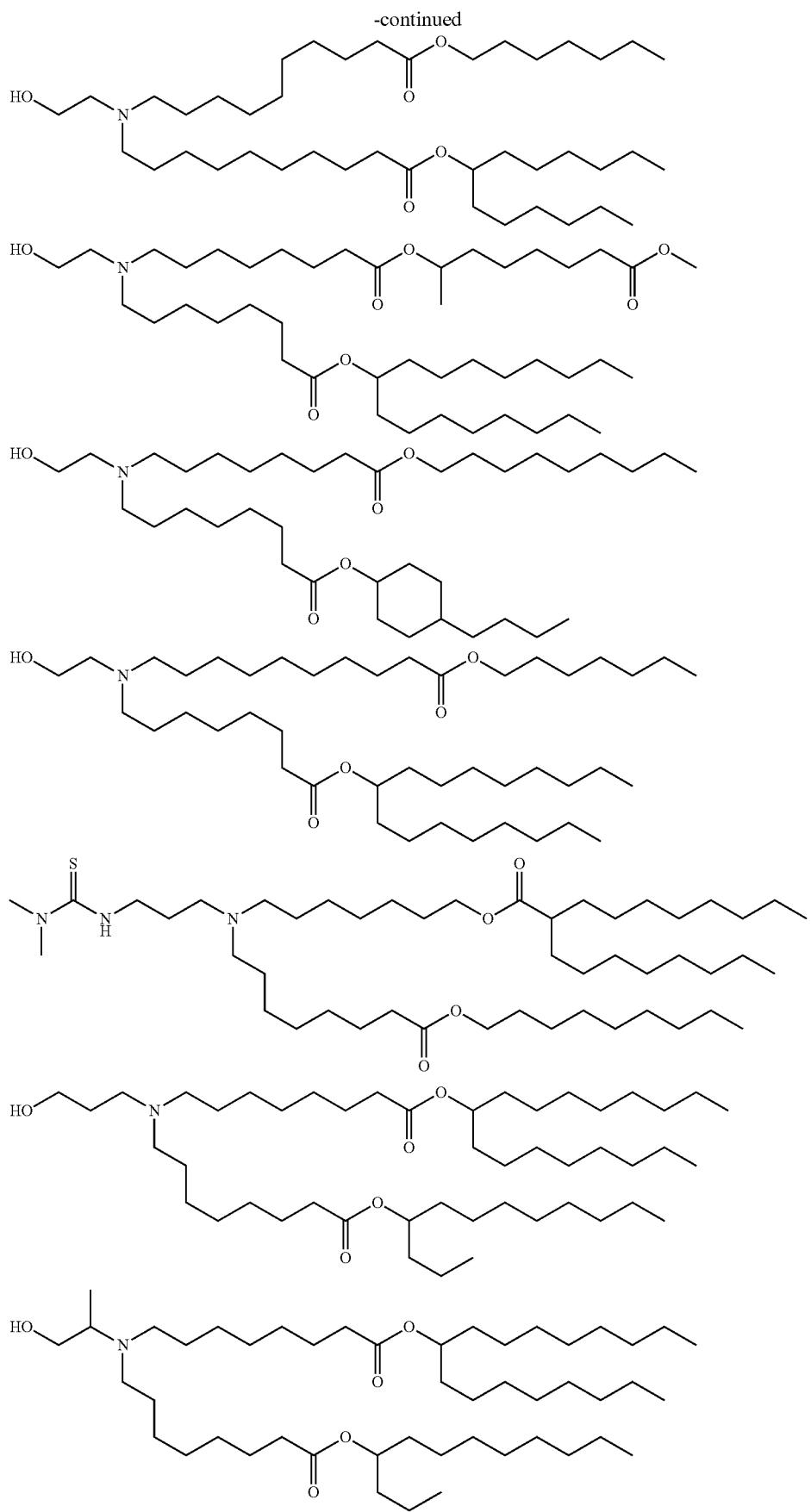

-continued
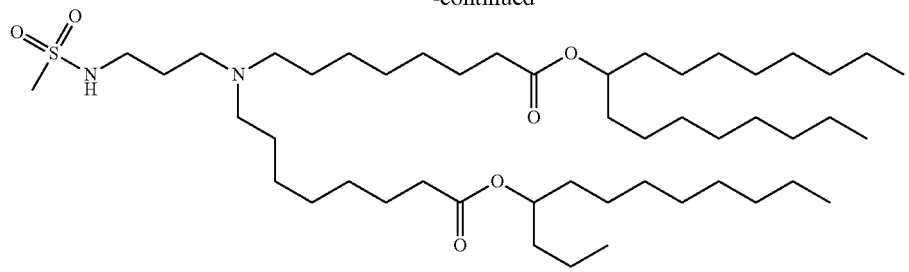
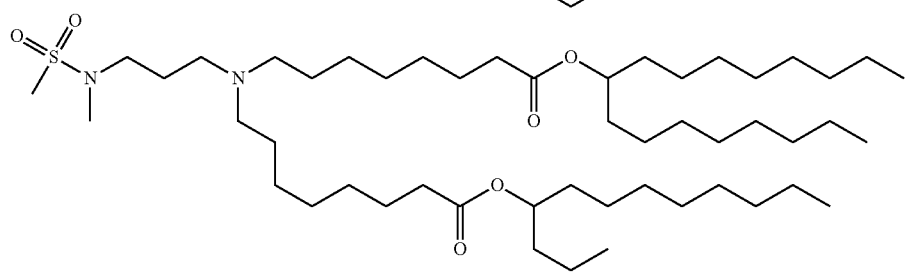
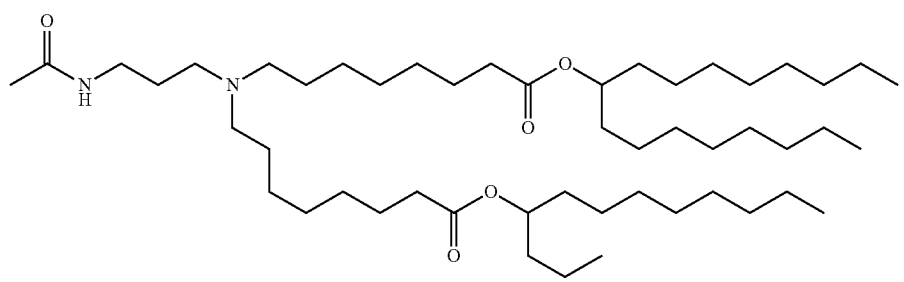
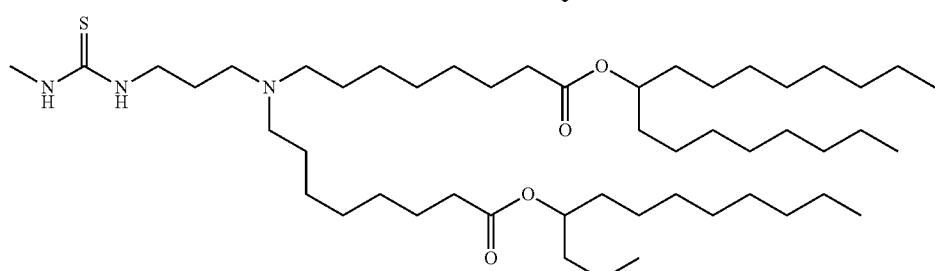
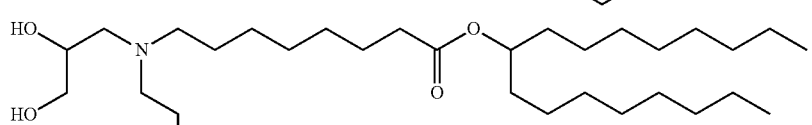
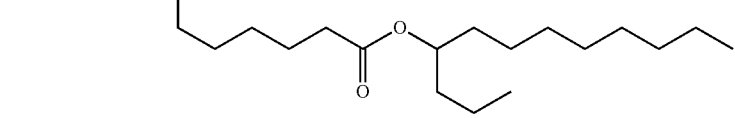
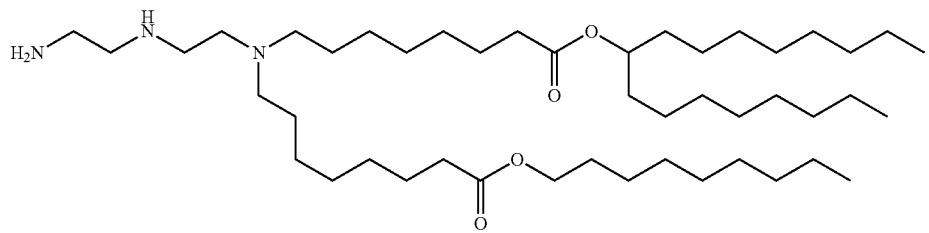

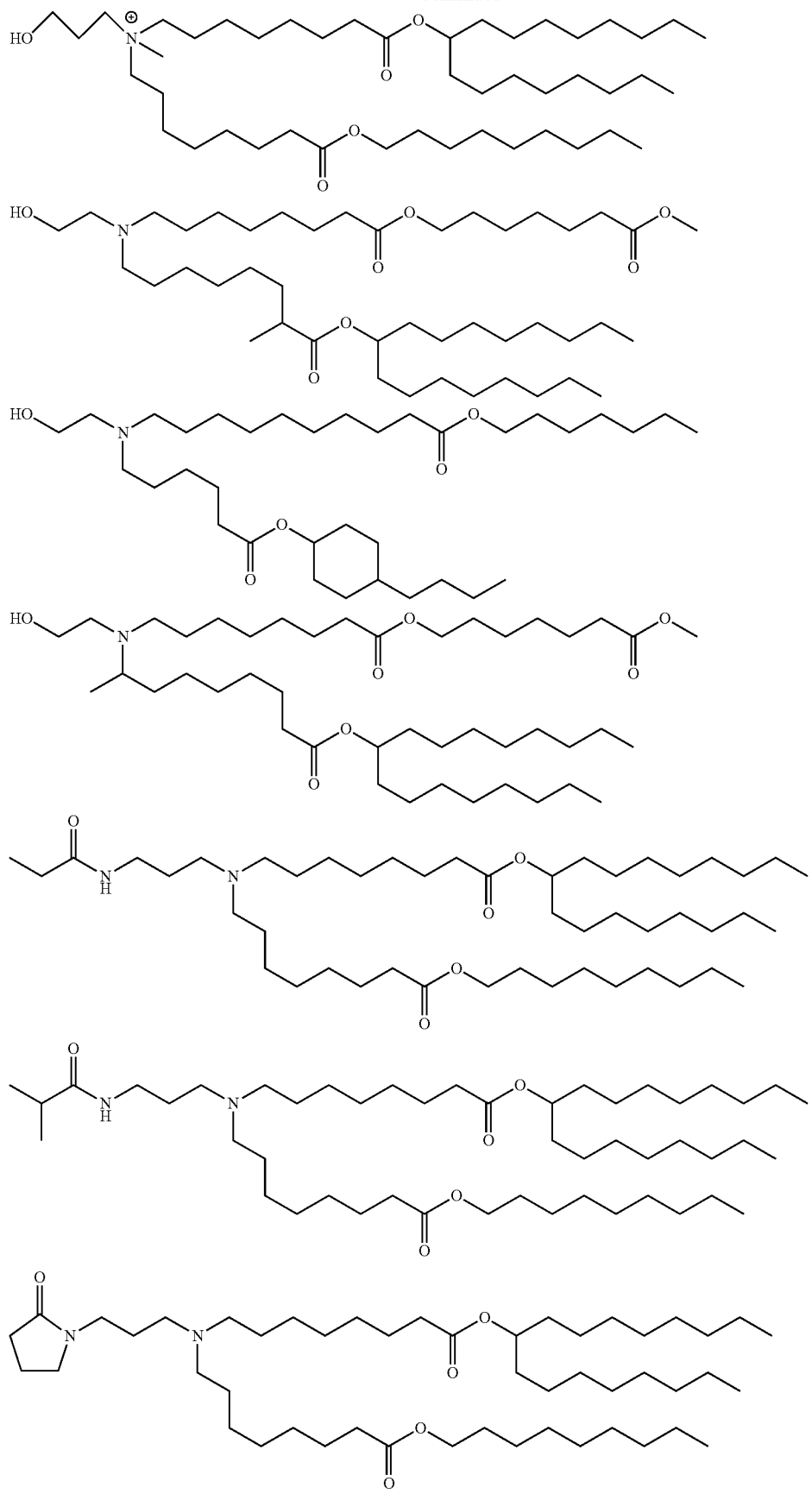

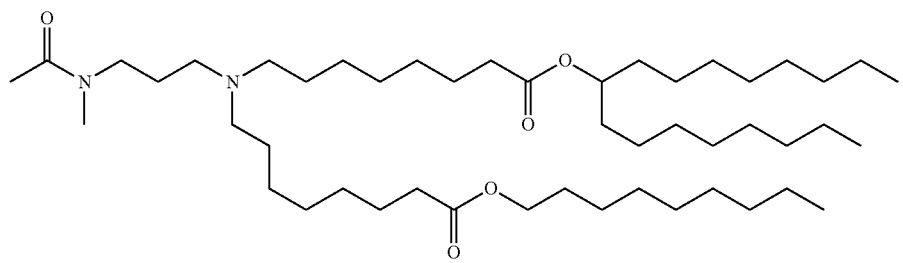
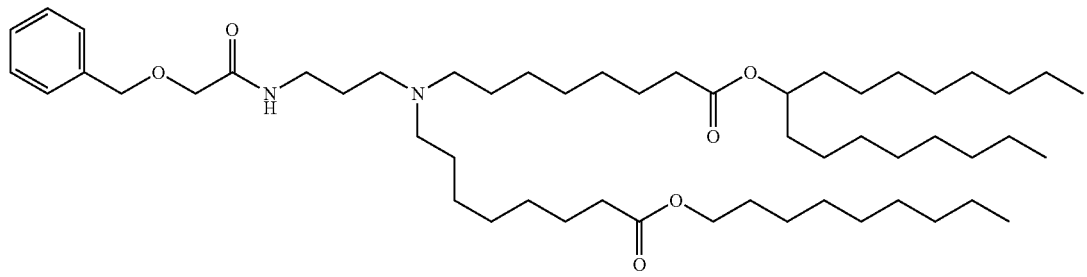
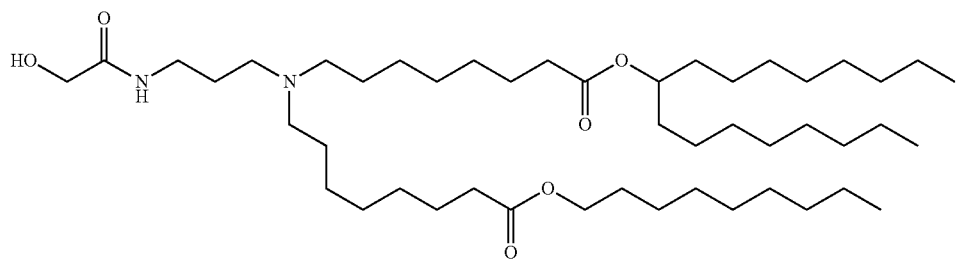
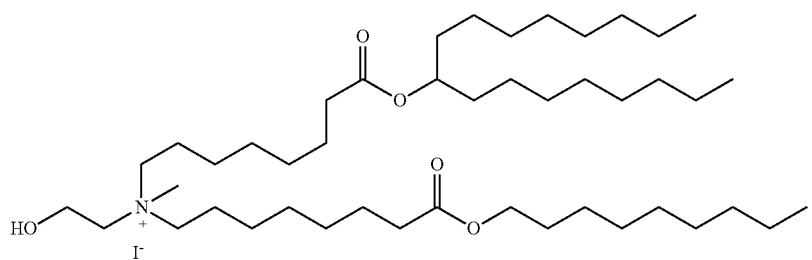
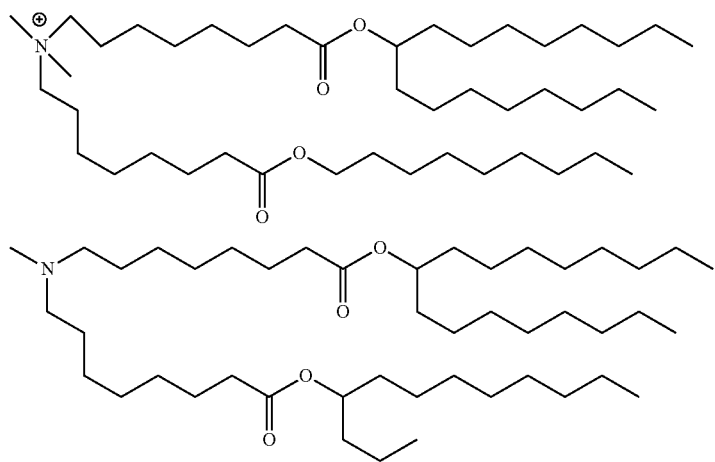

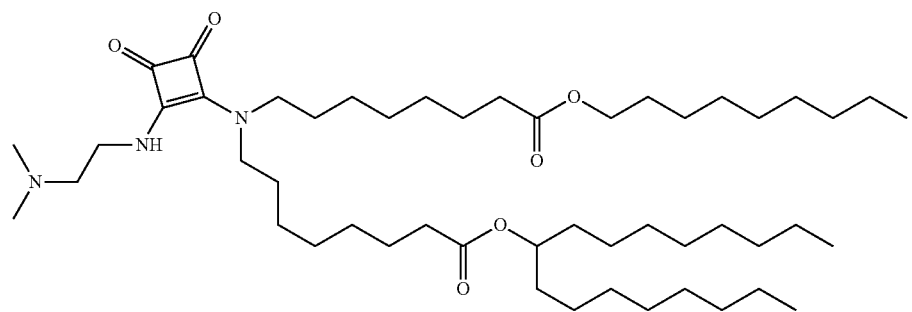
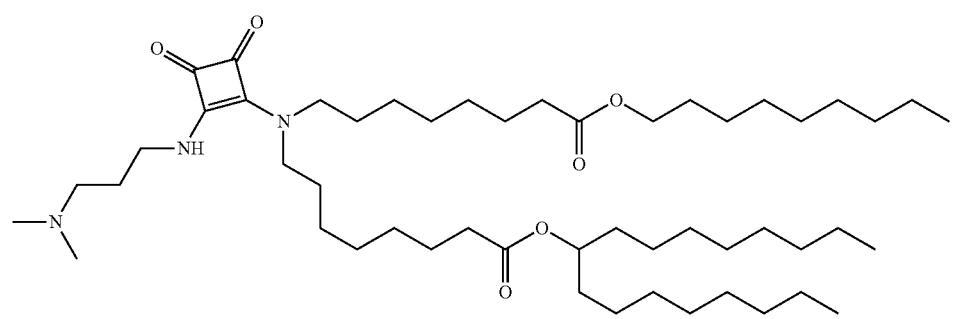
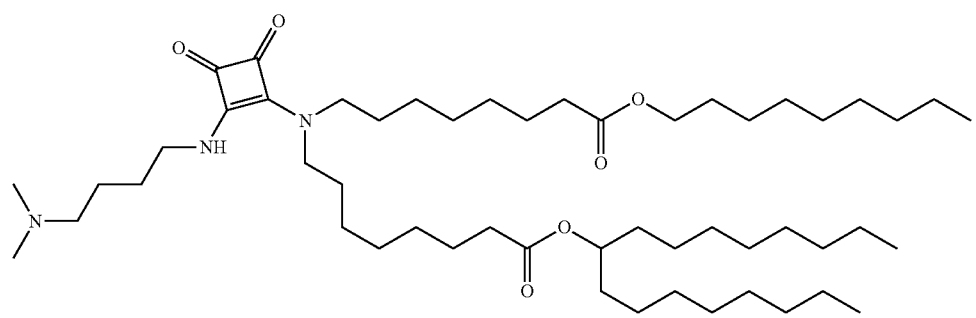
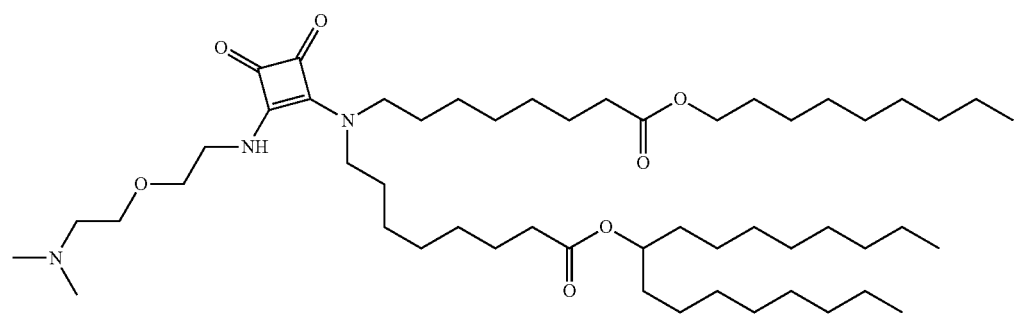 [SMILES: CCCCCCCCCOC(=O)CCCCCCCN(CCCCCCCC(=O)OC(CCCCCCCC)CCCCCCCC)c1c(NCCOCCN(C)C)c(=O)c1=O]
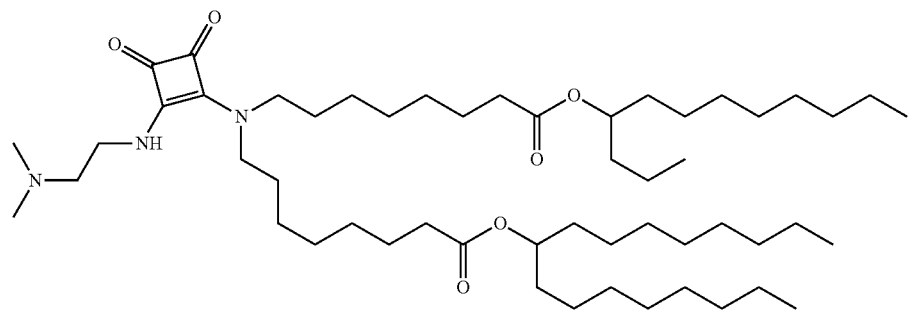

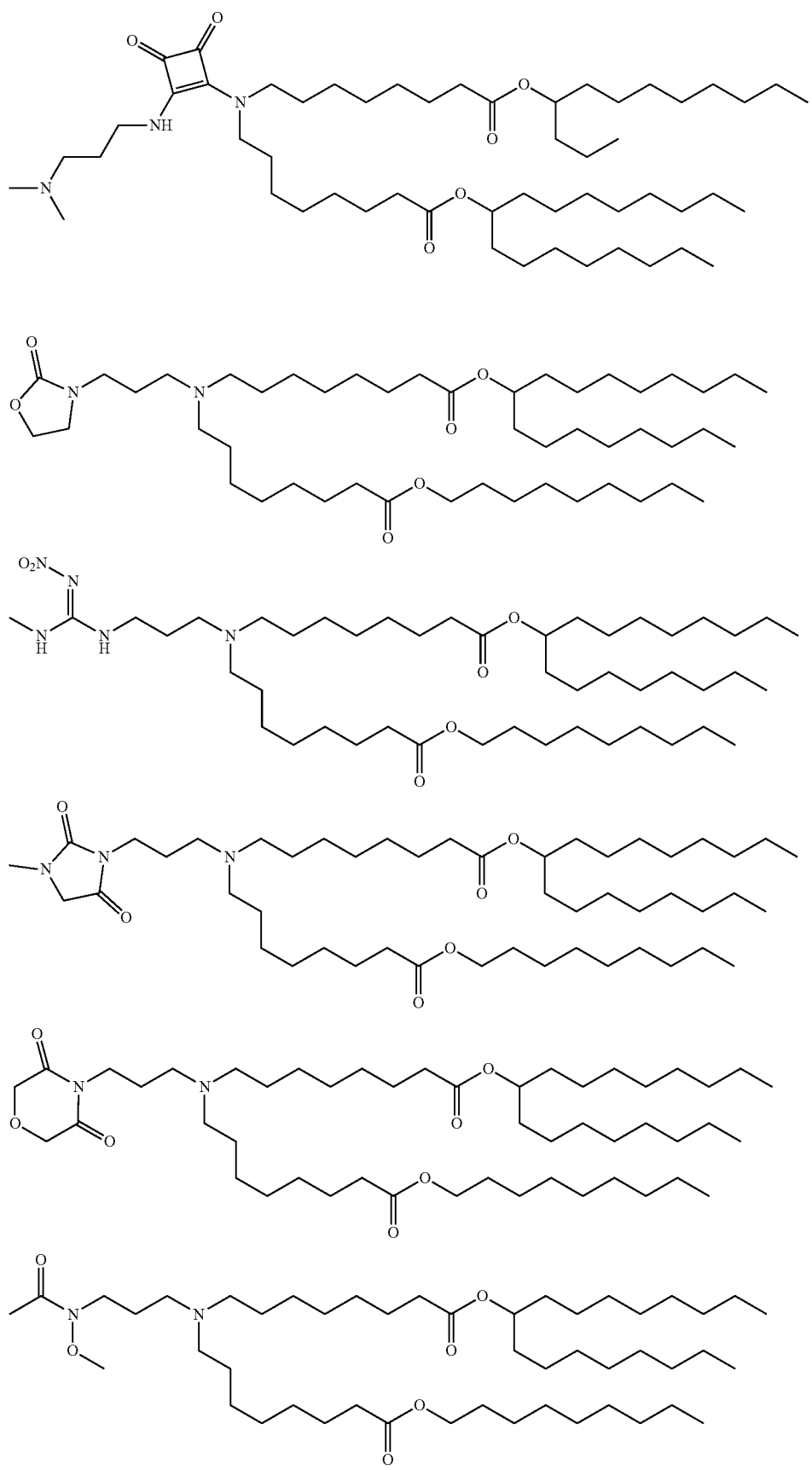

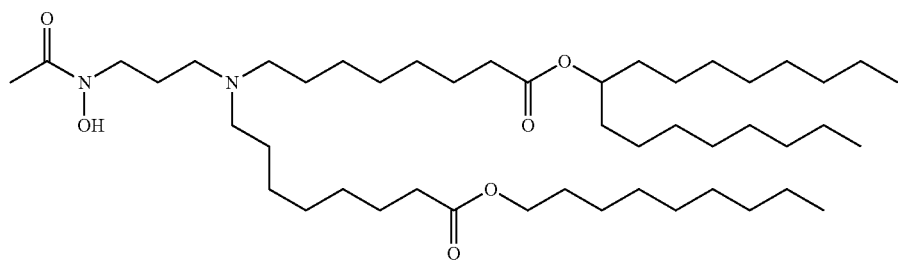
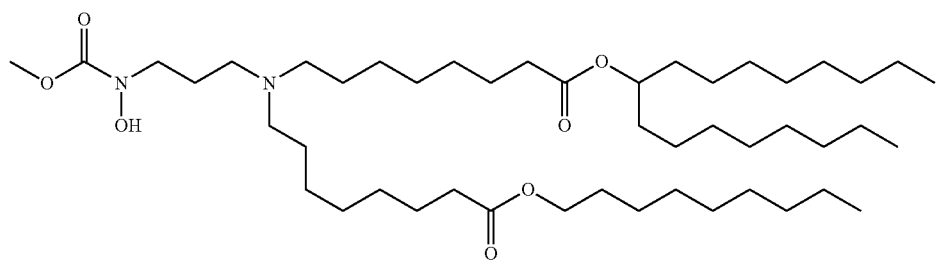
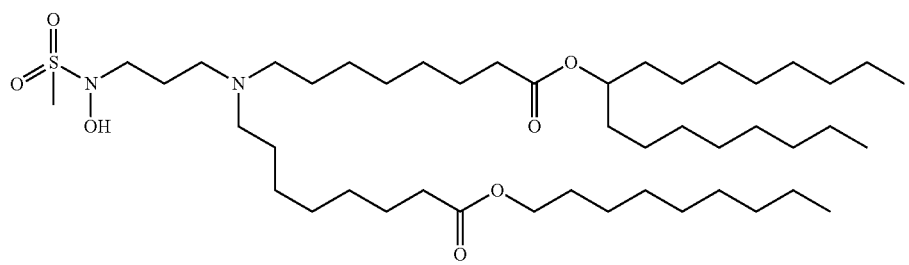
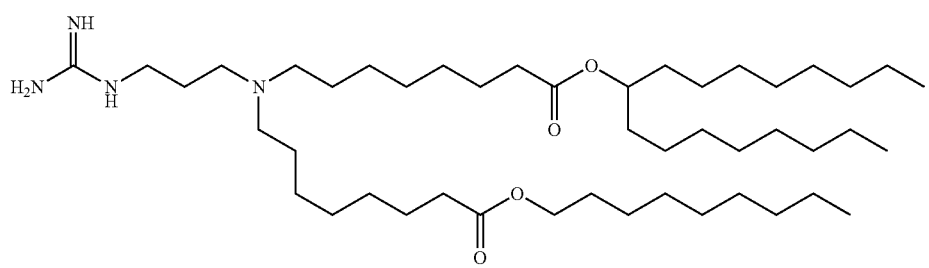
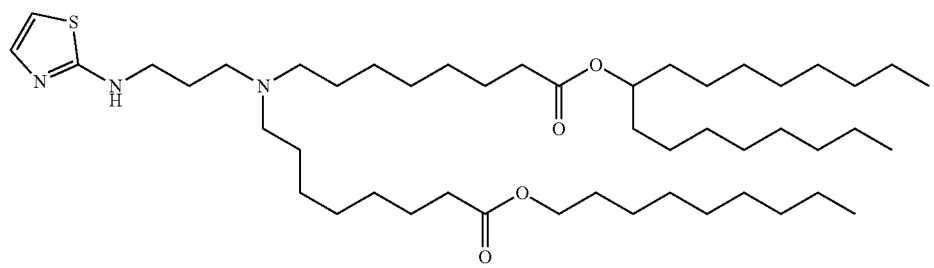
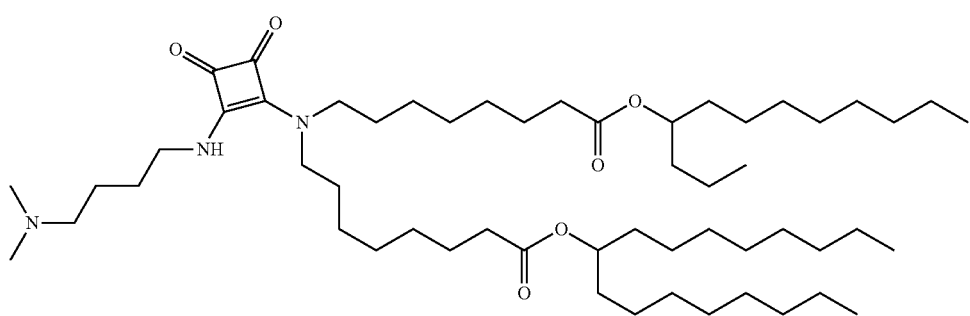

-continued
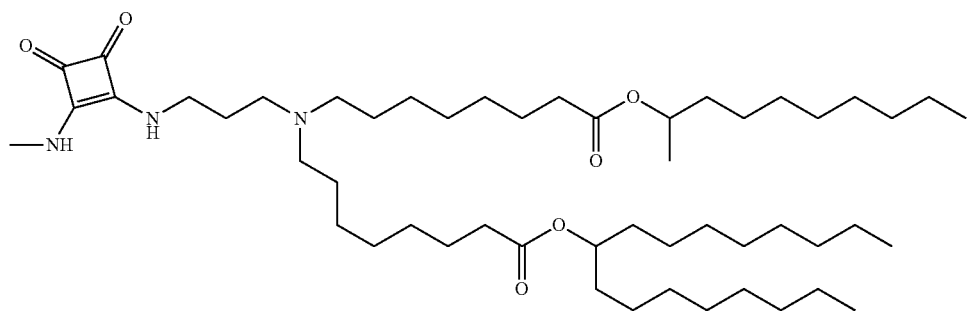
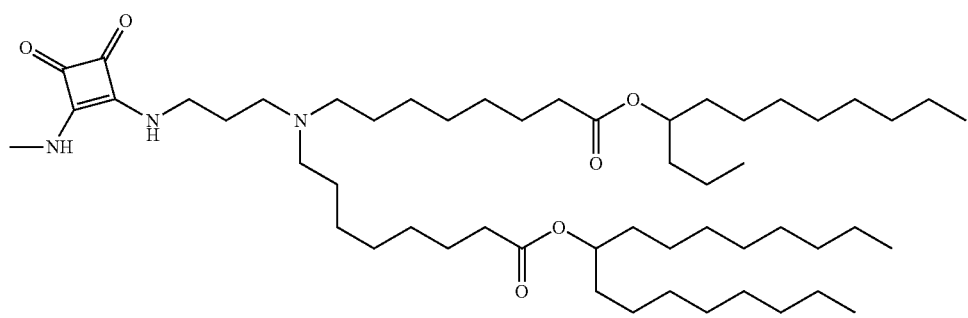
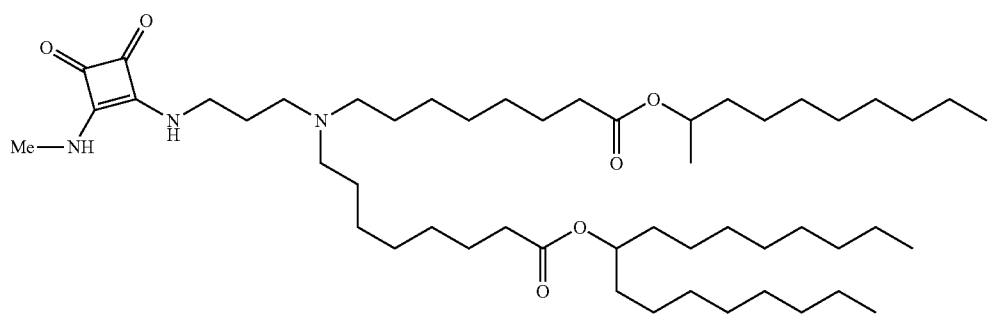
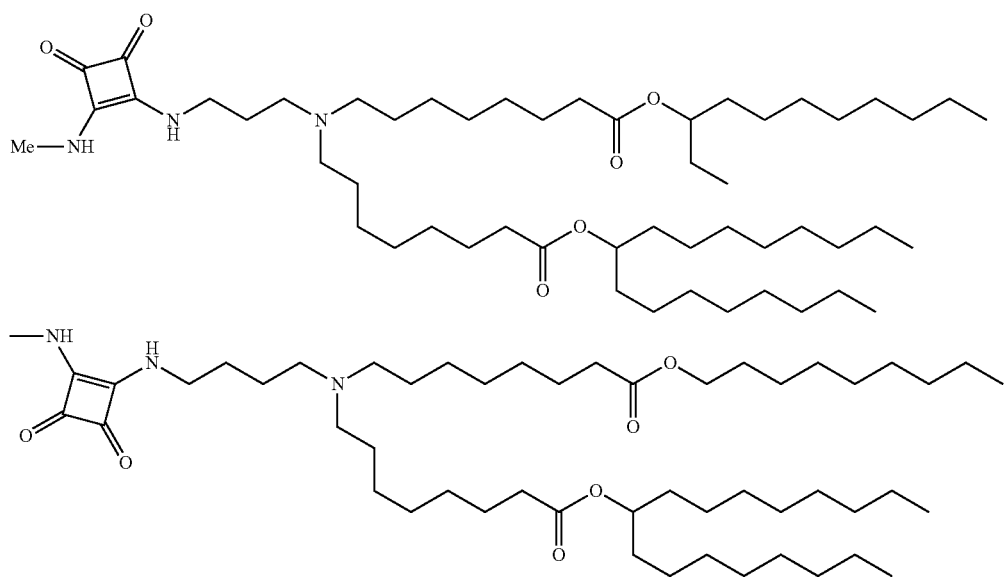

-continued
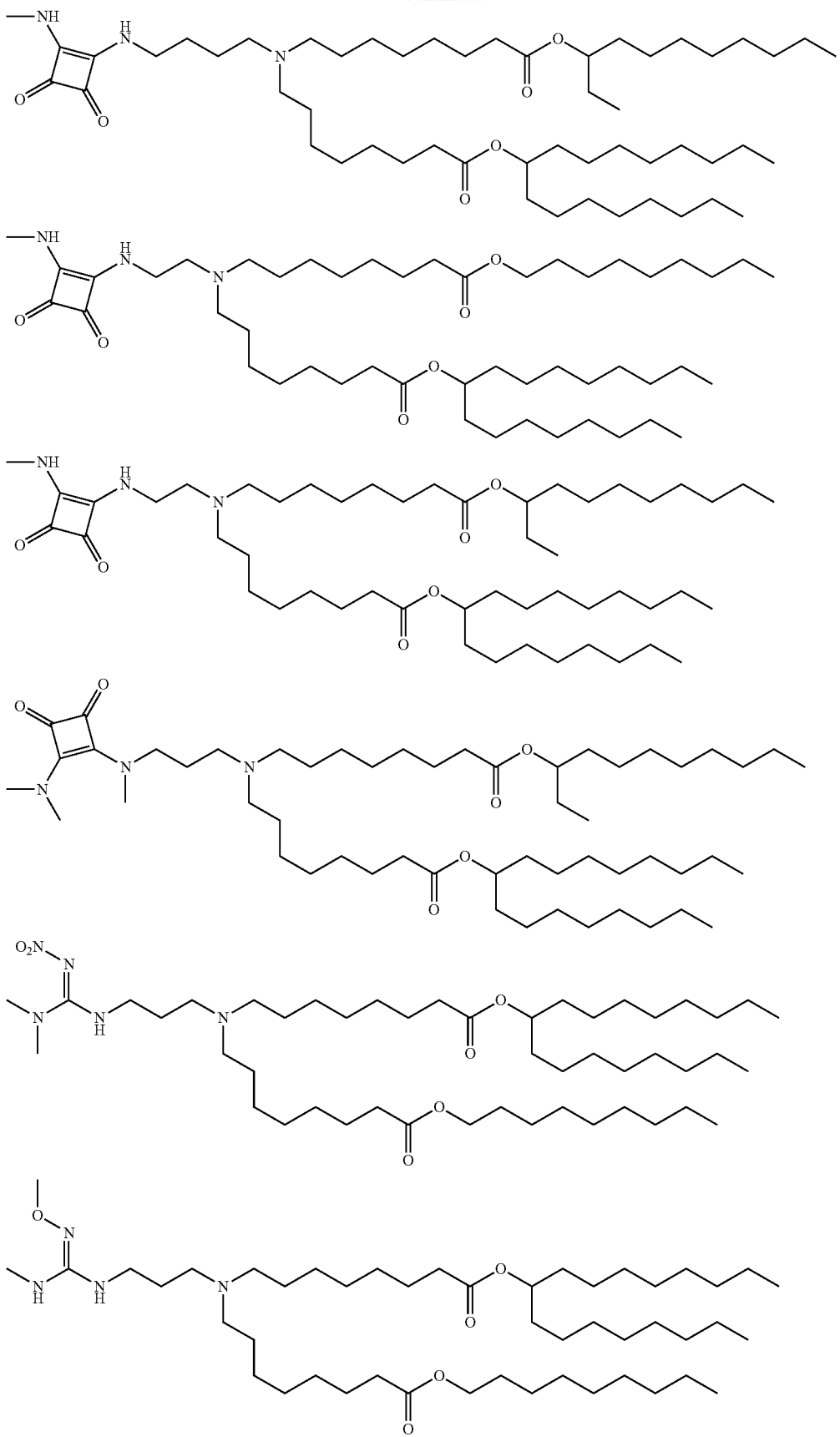

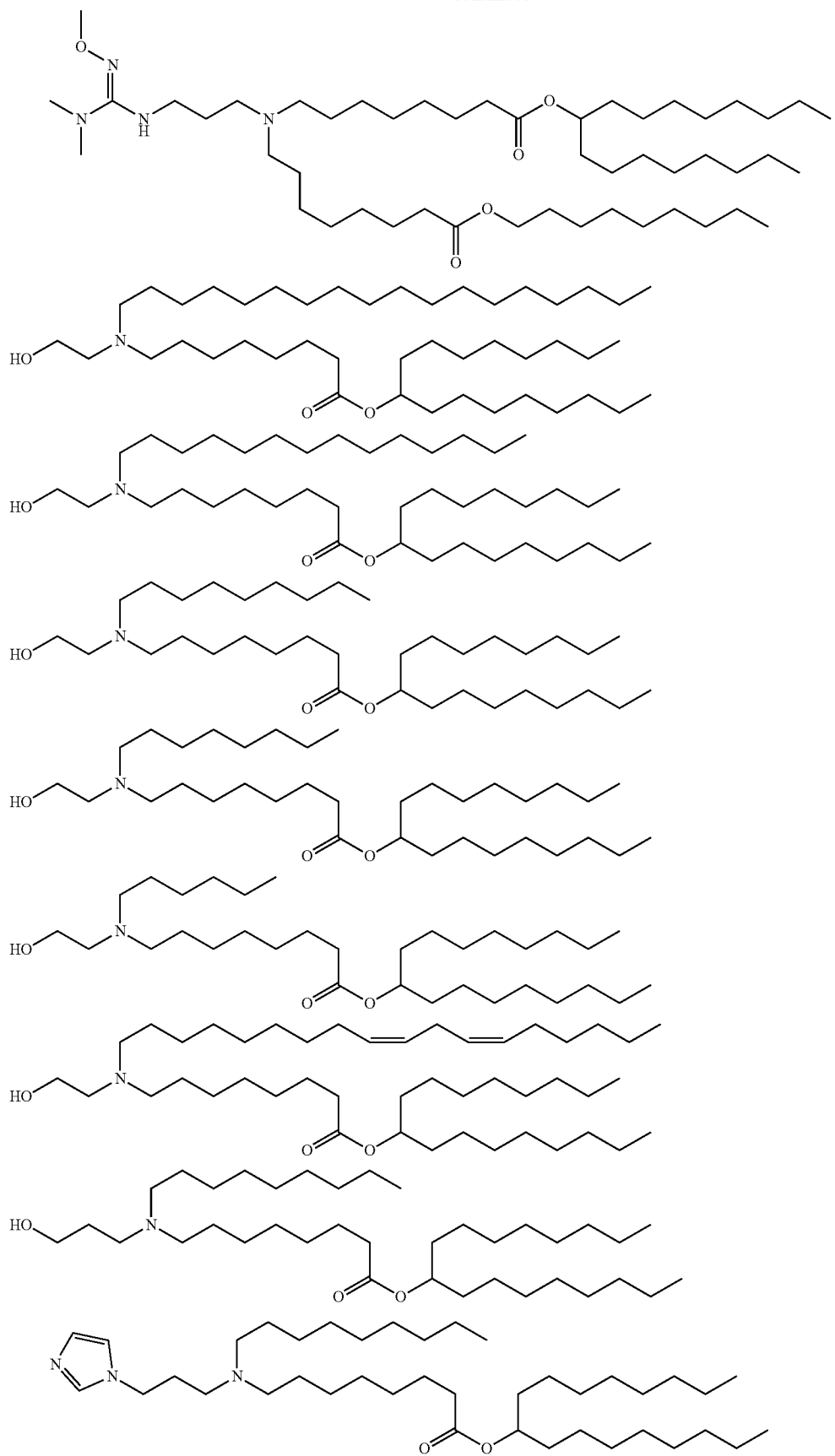

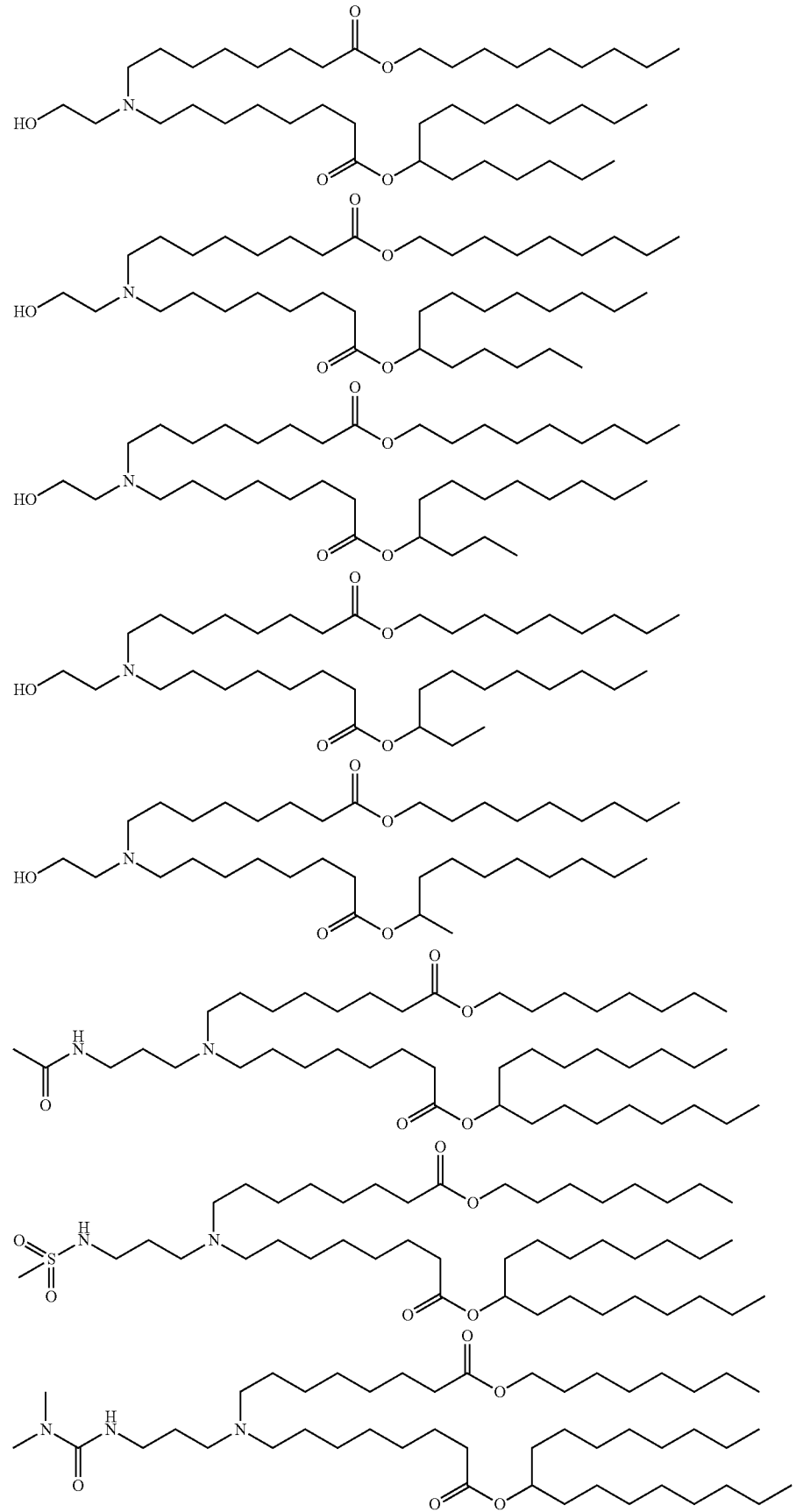

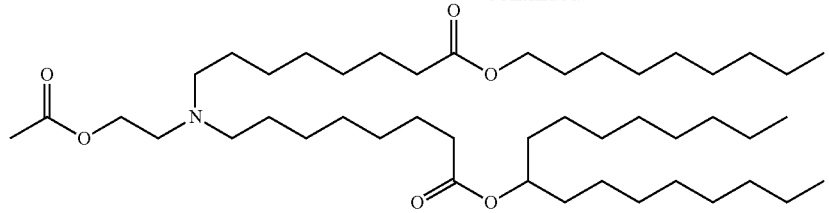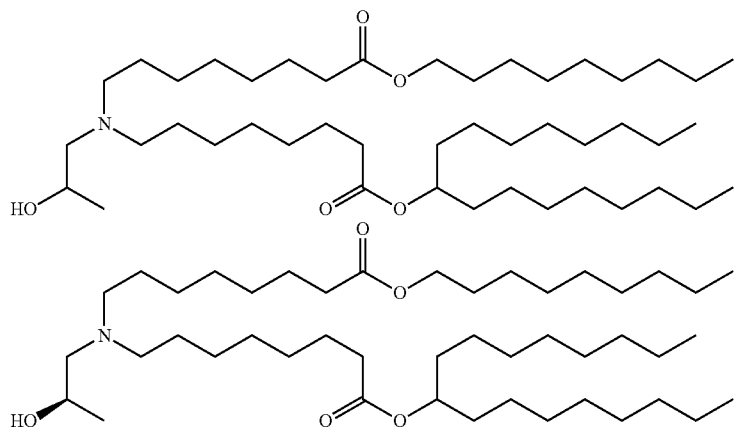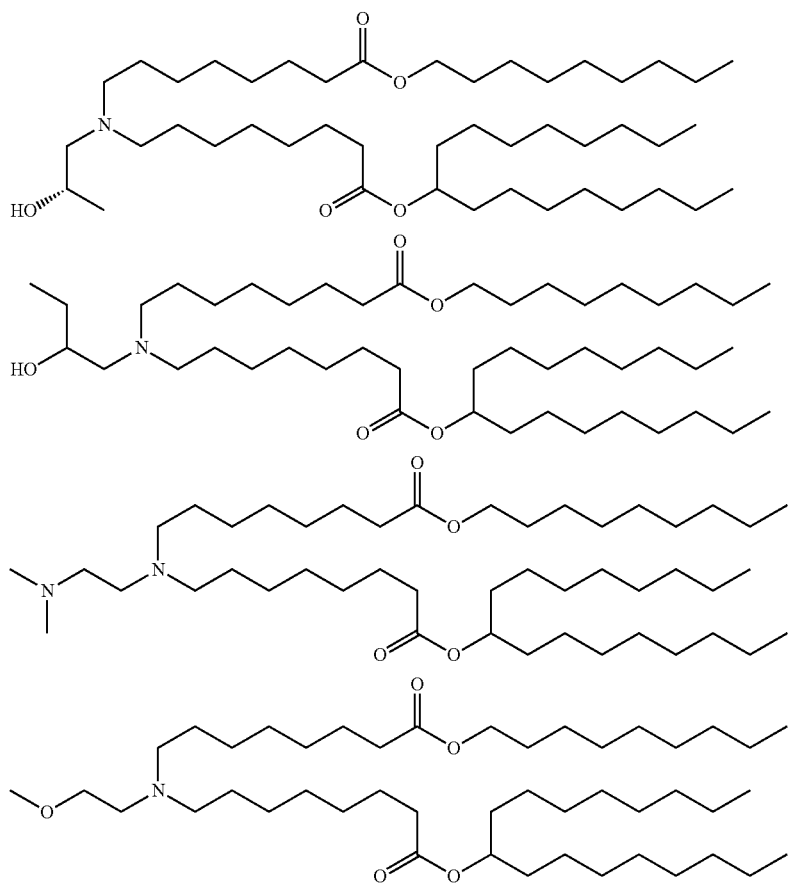

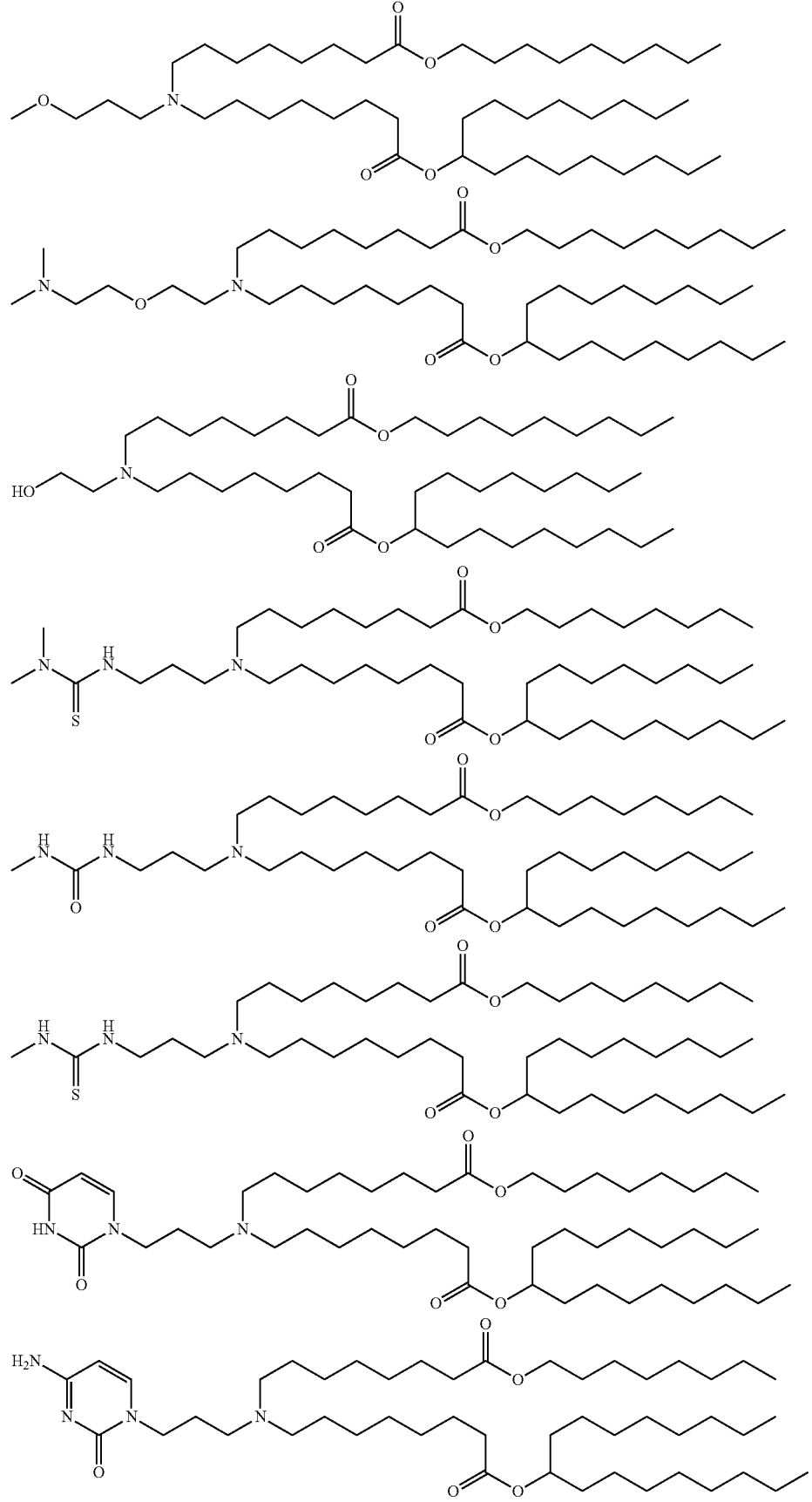

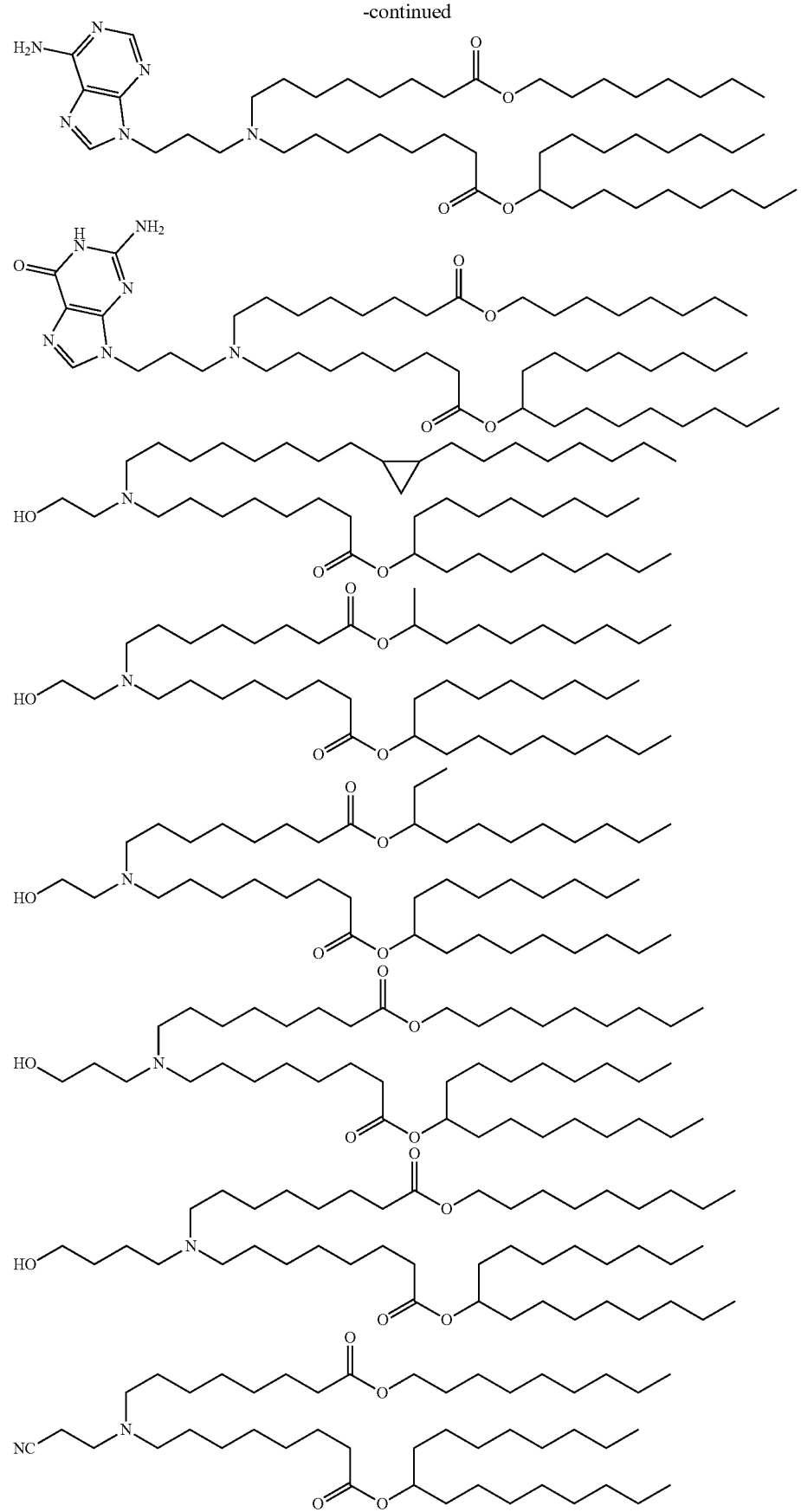

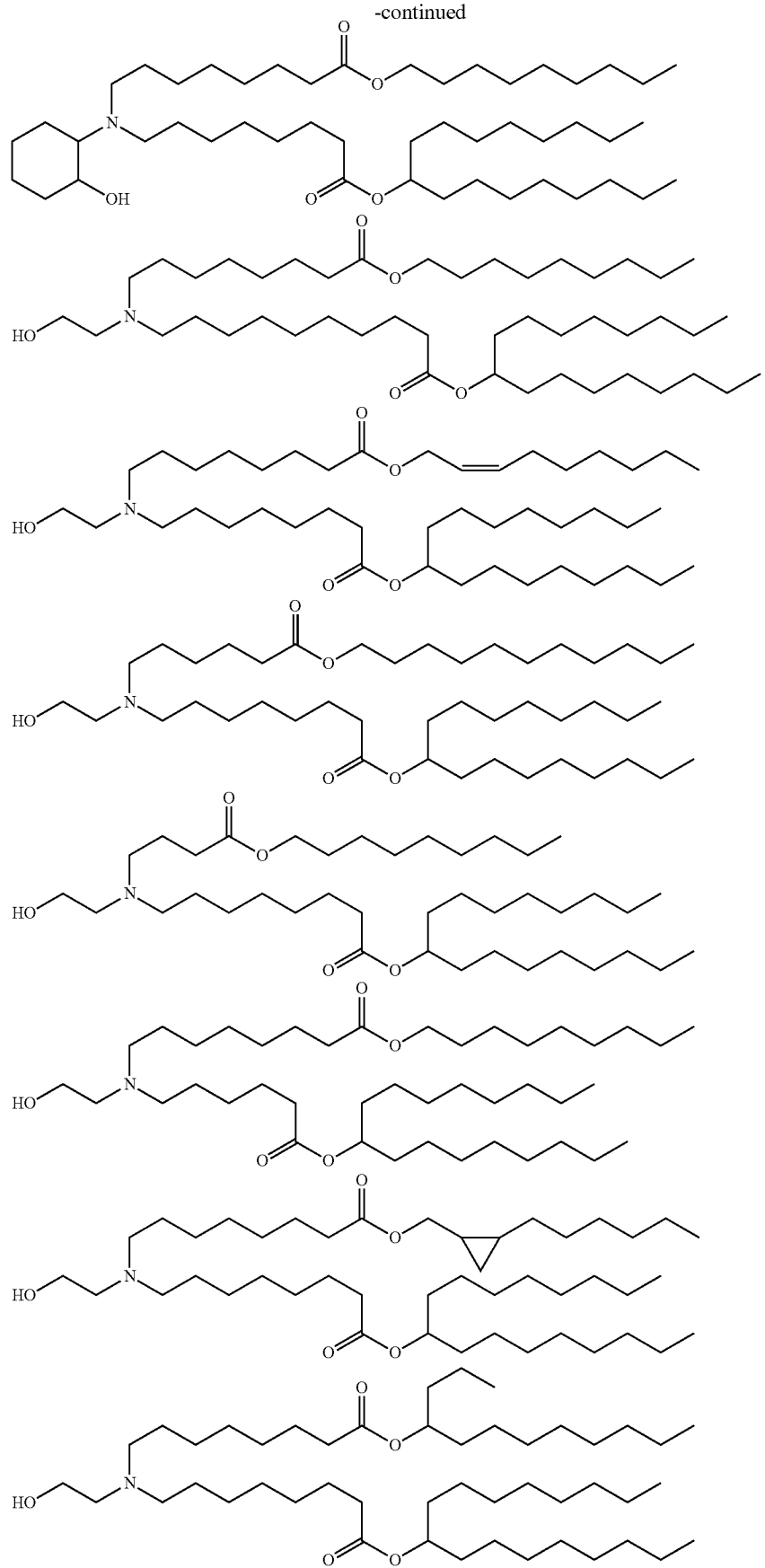

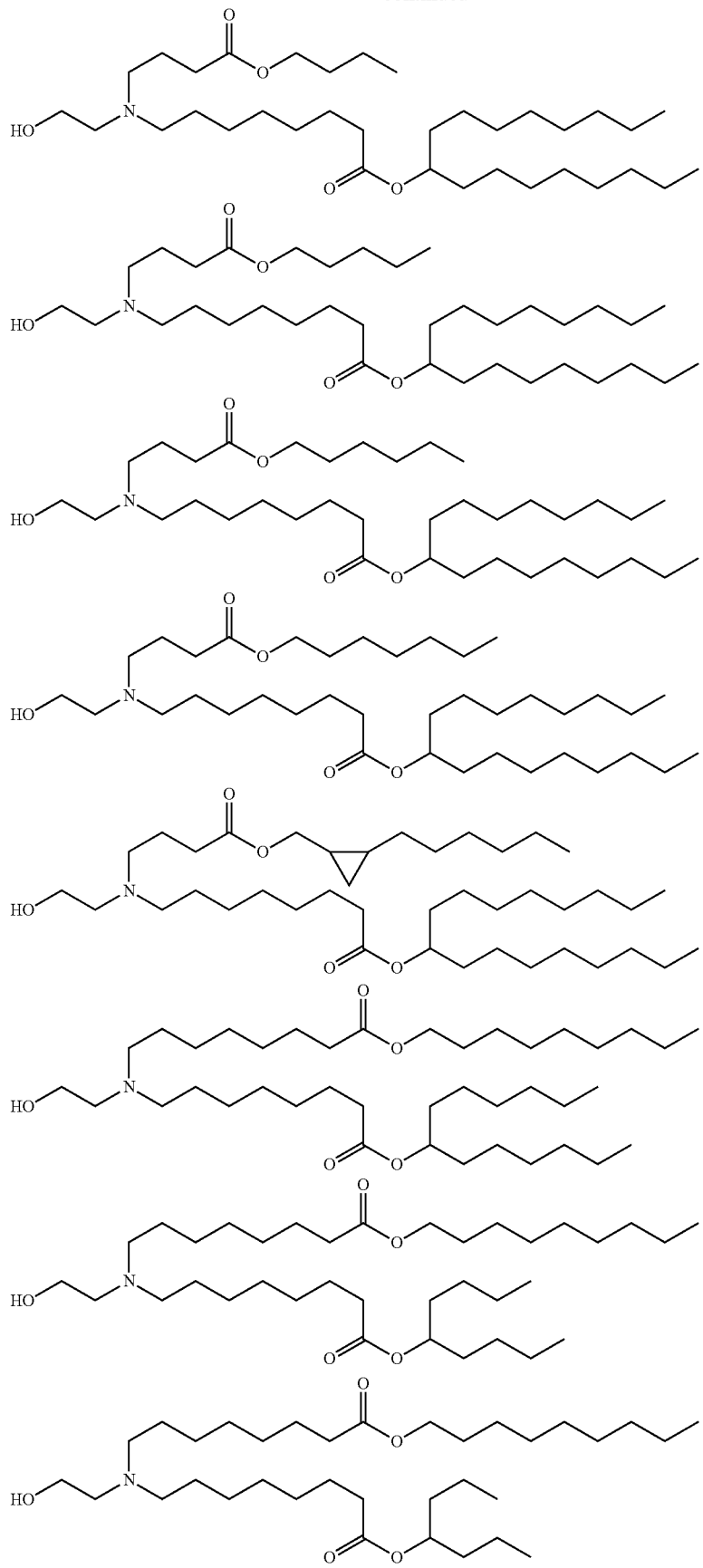

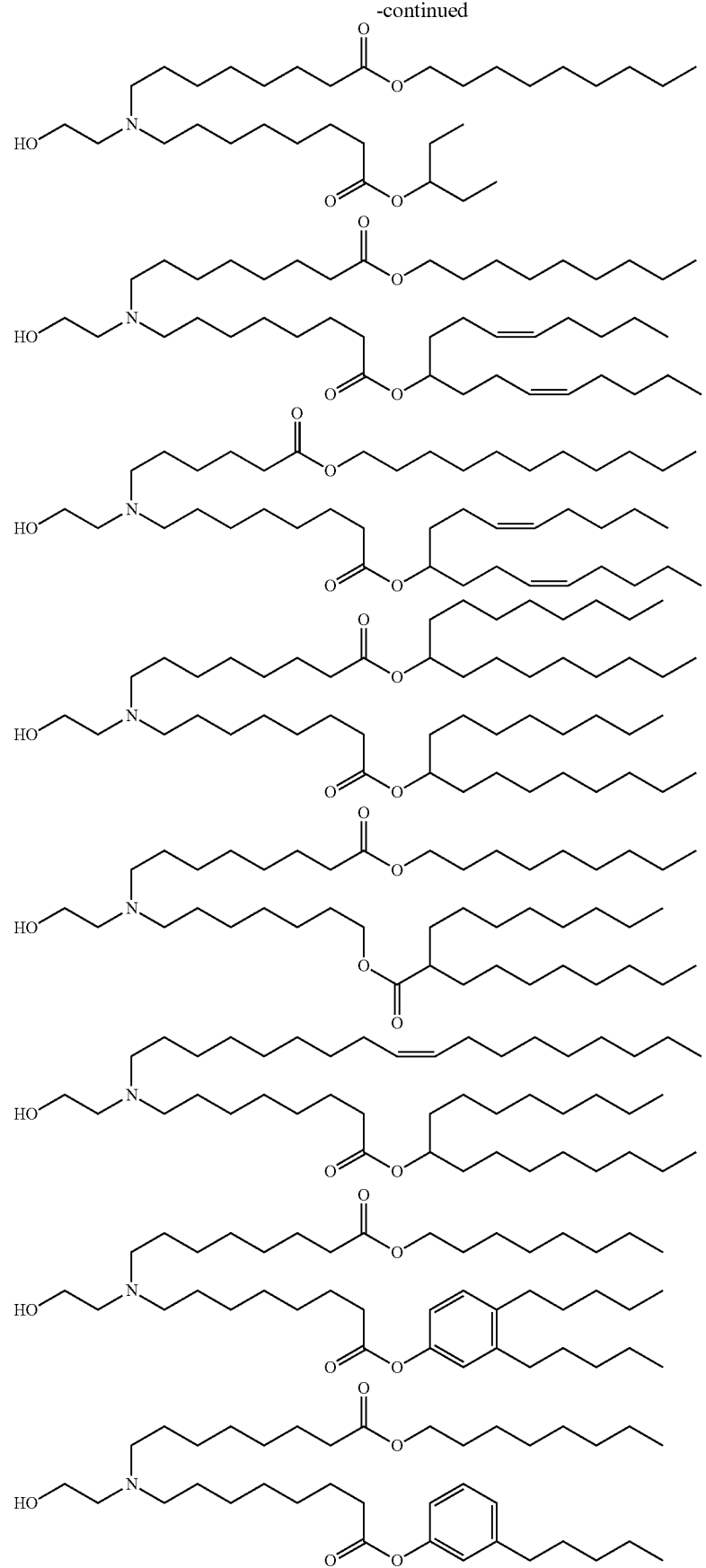

-continued
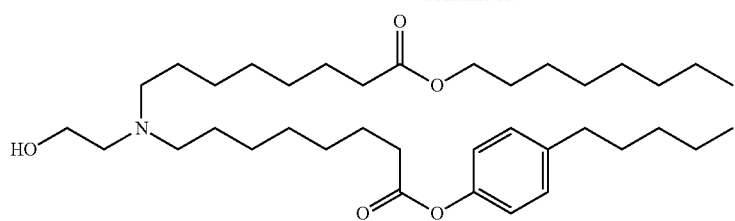
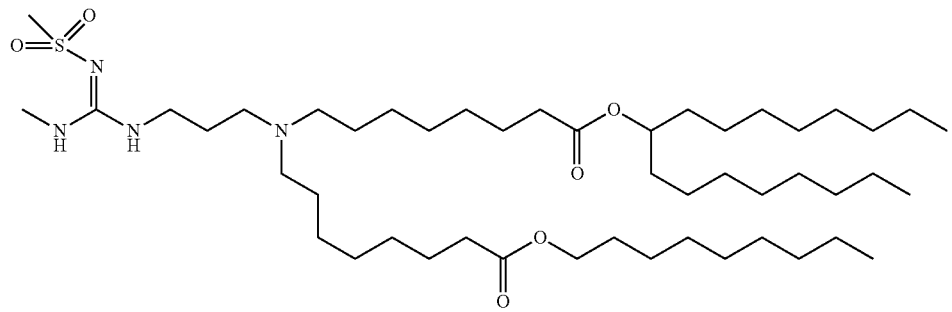
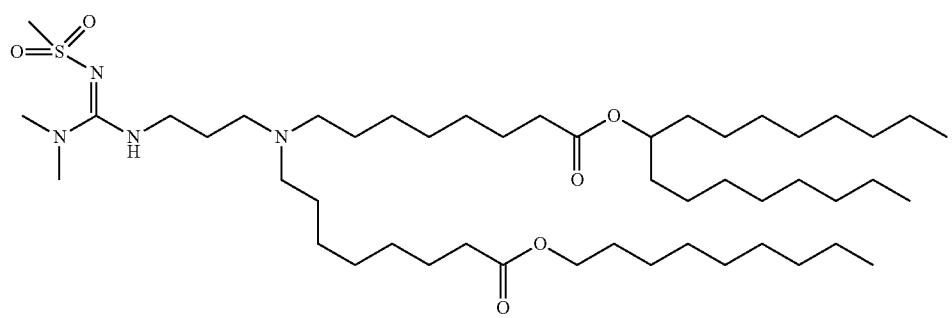
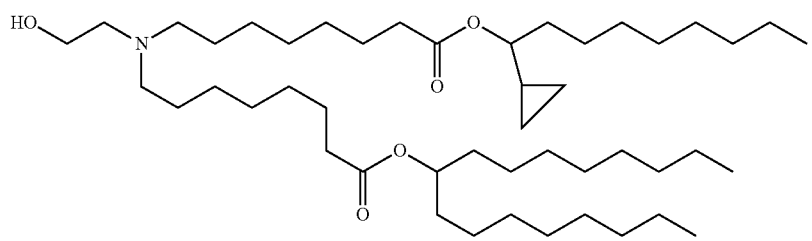
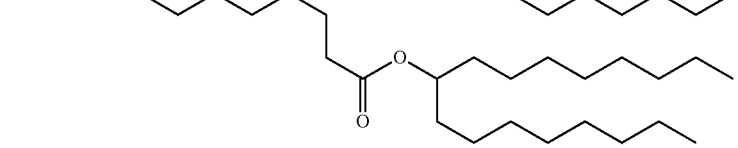
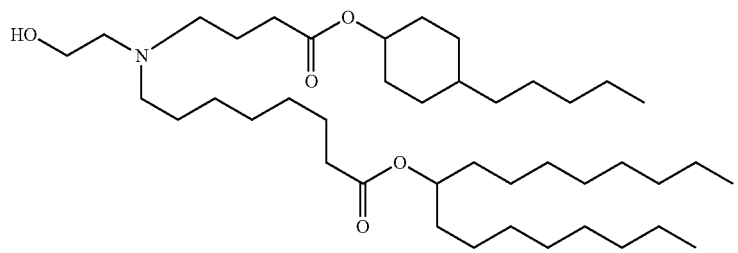

-continued
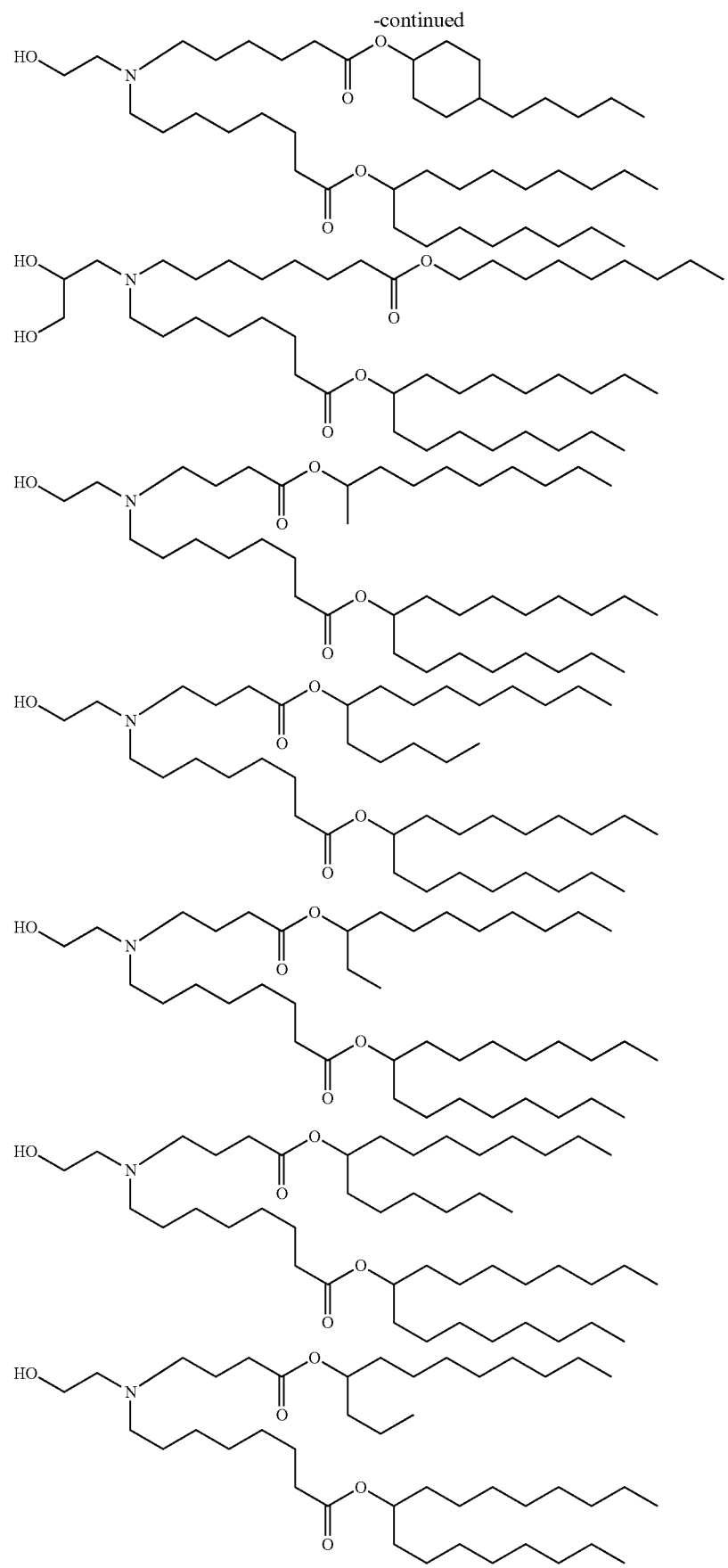

-continued
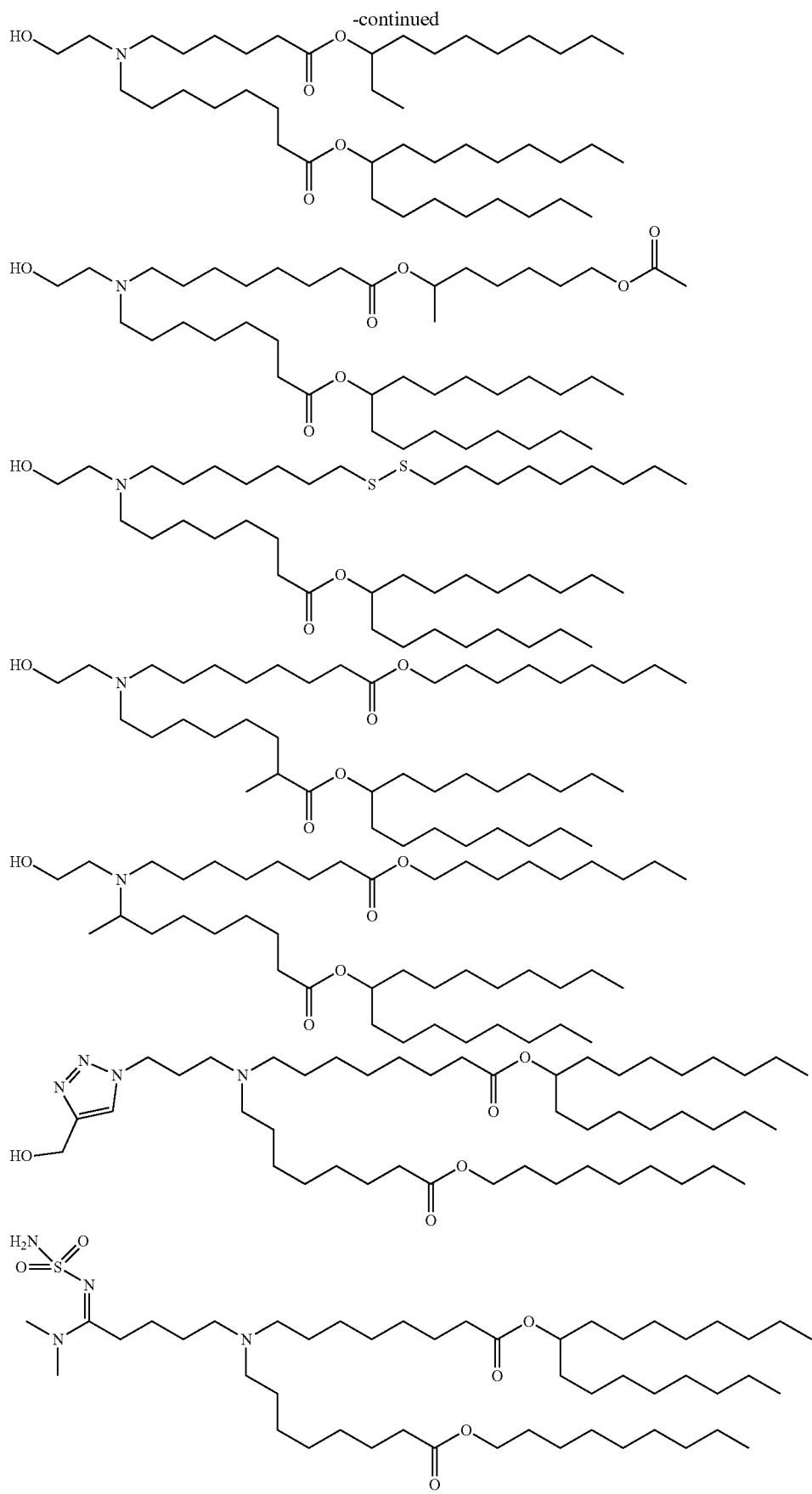

-continued
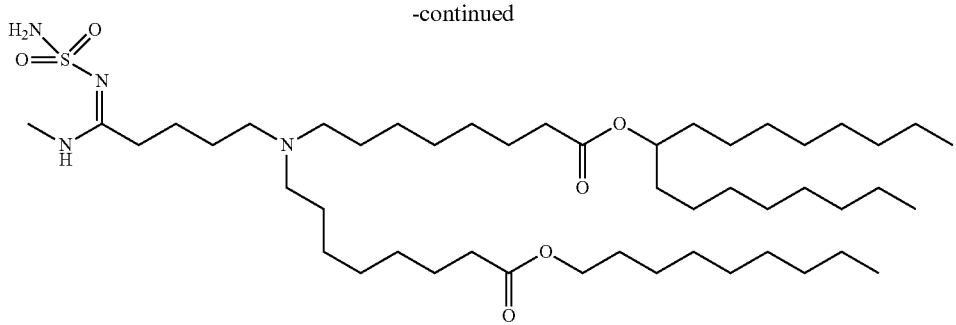
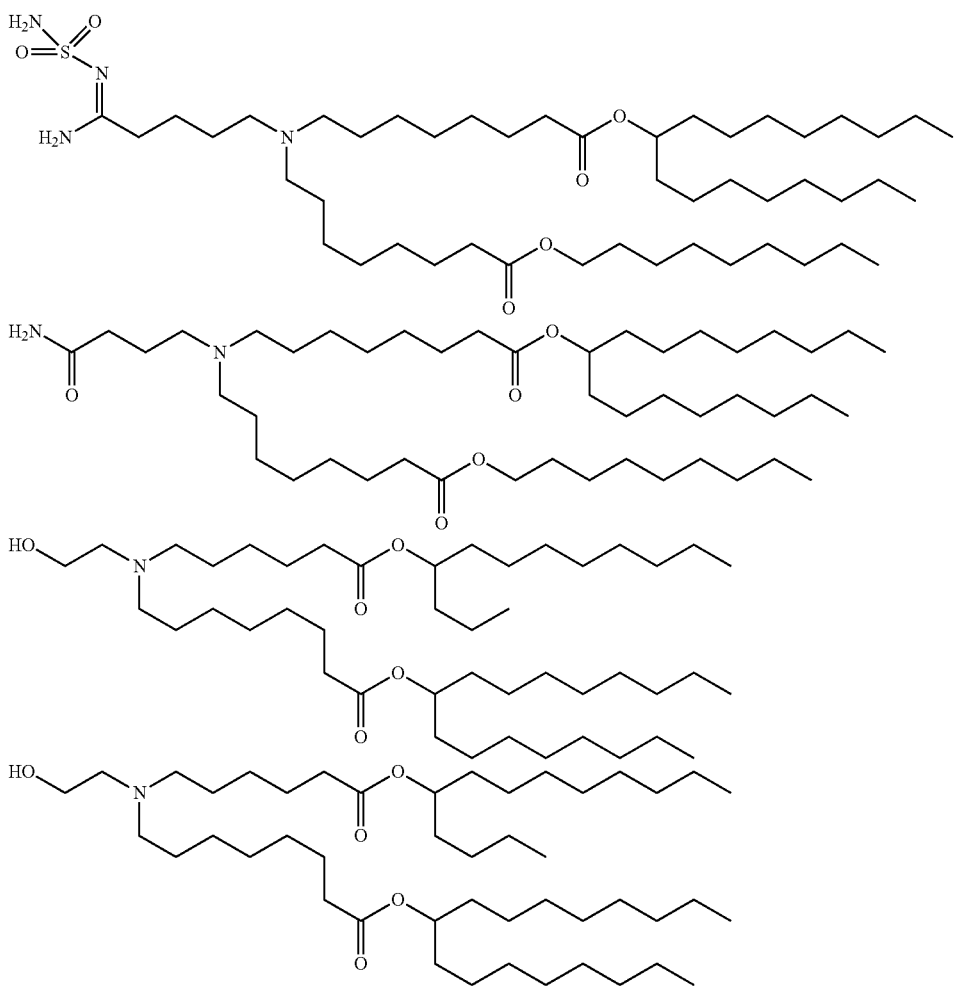
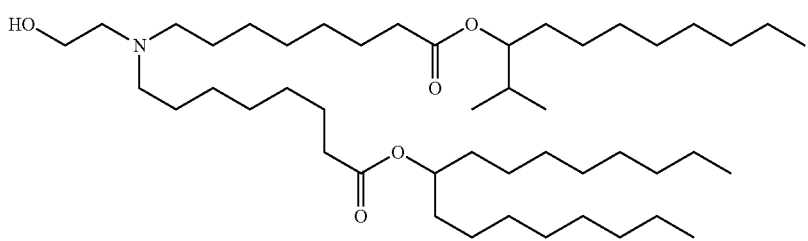

-continued
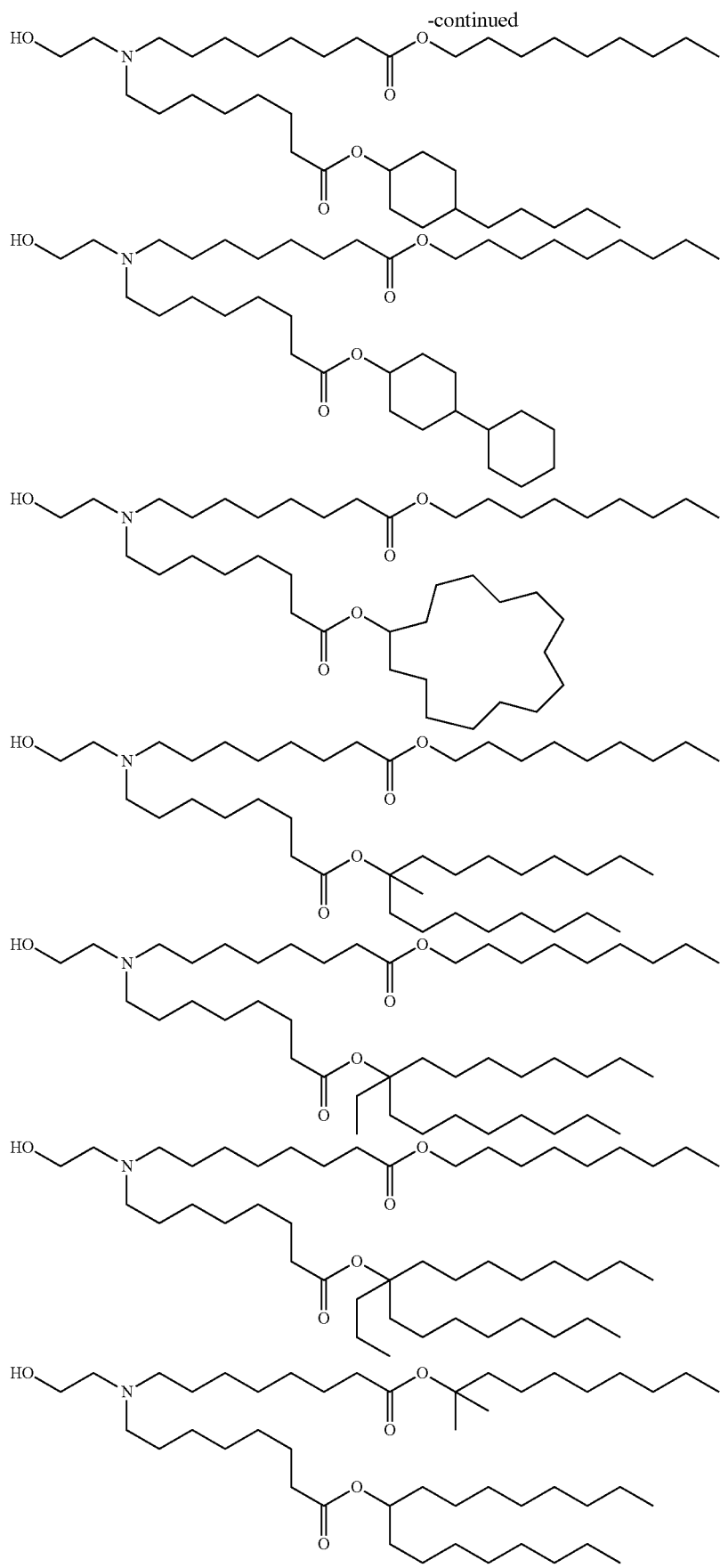

-continued
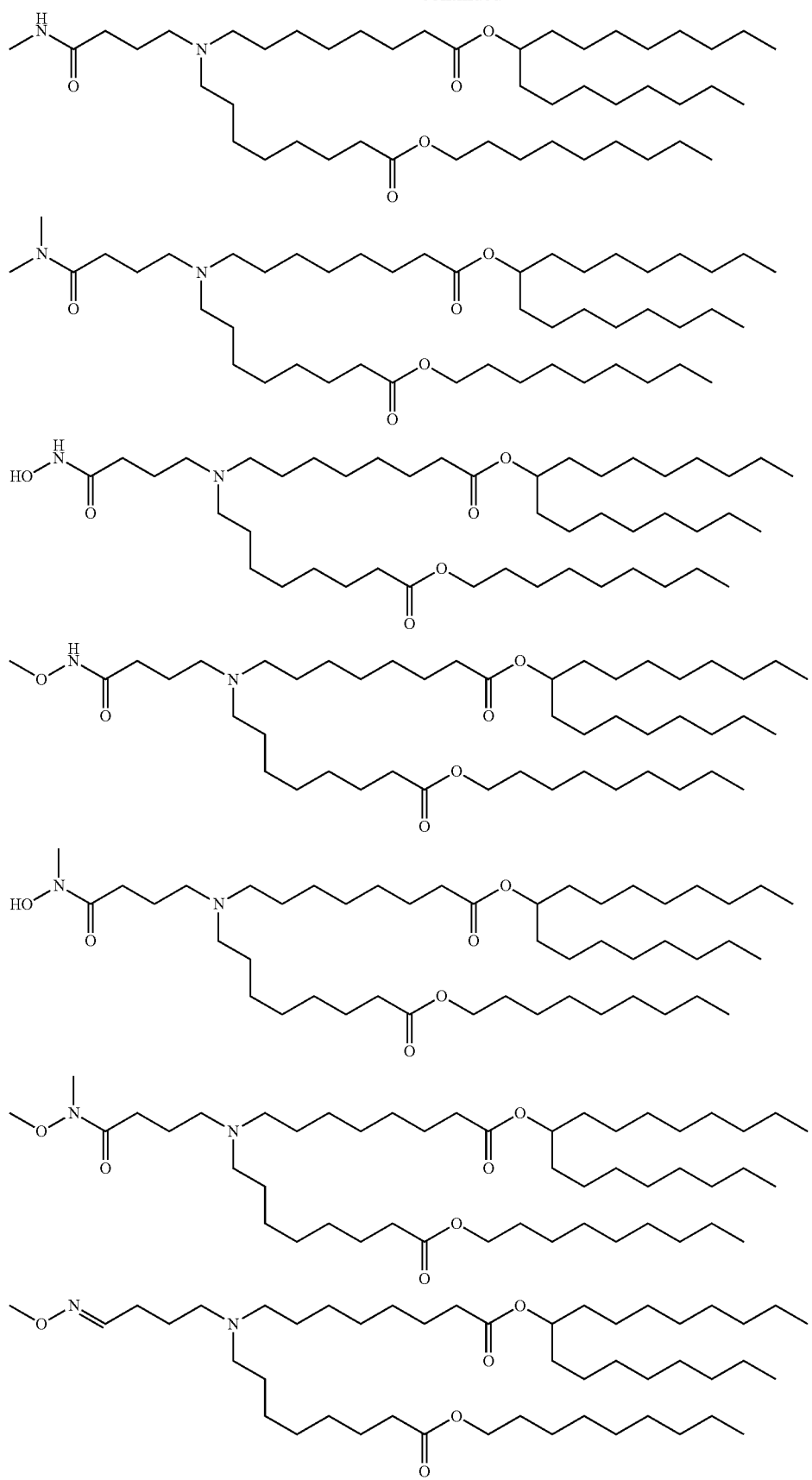

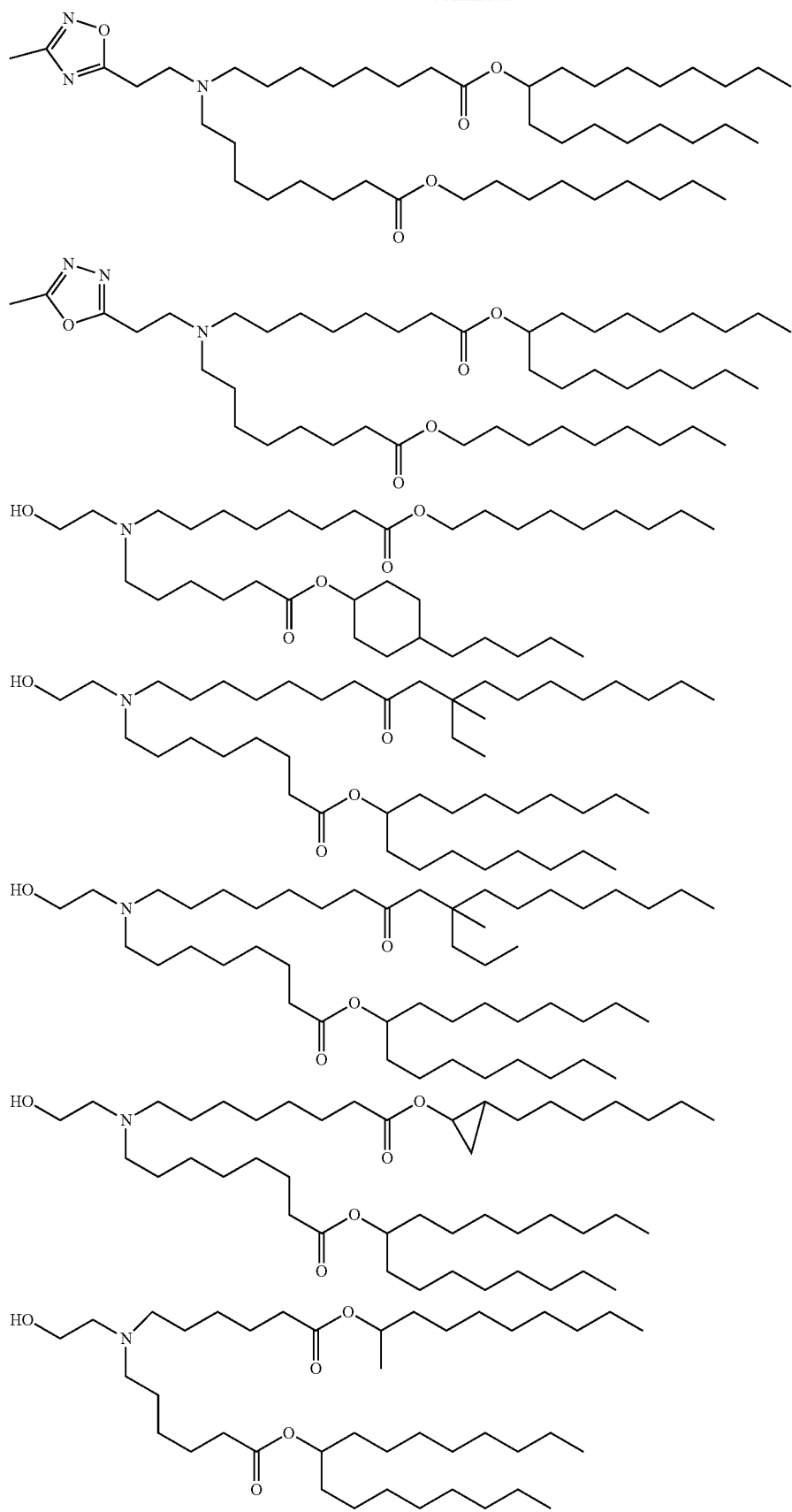

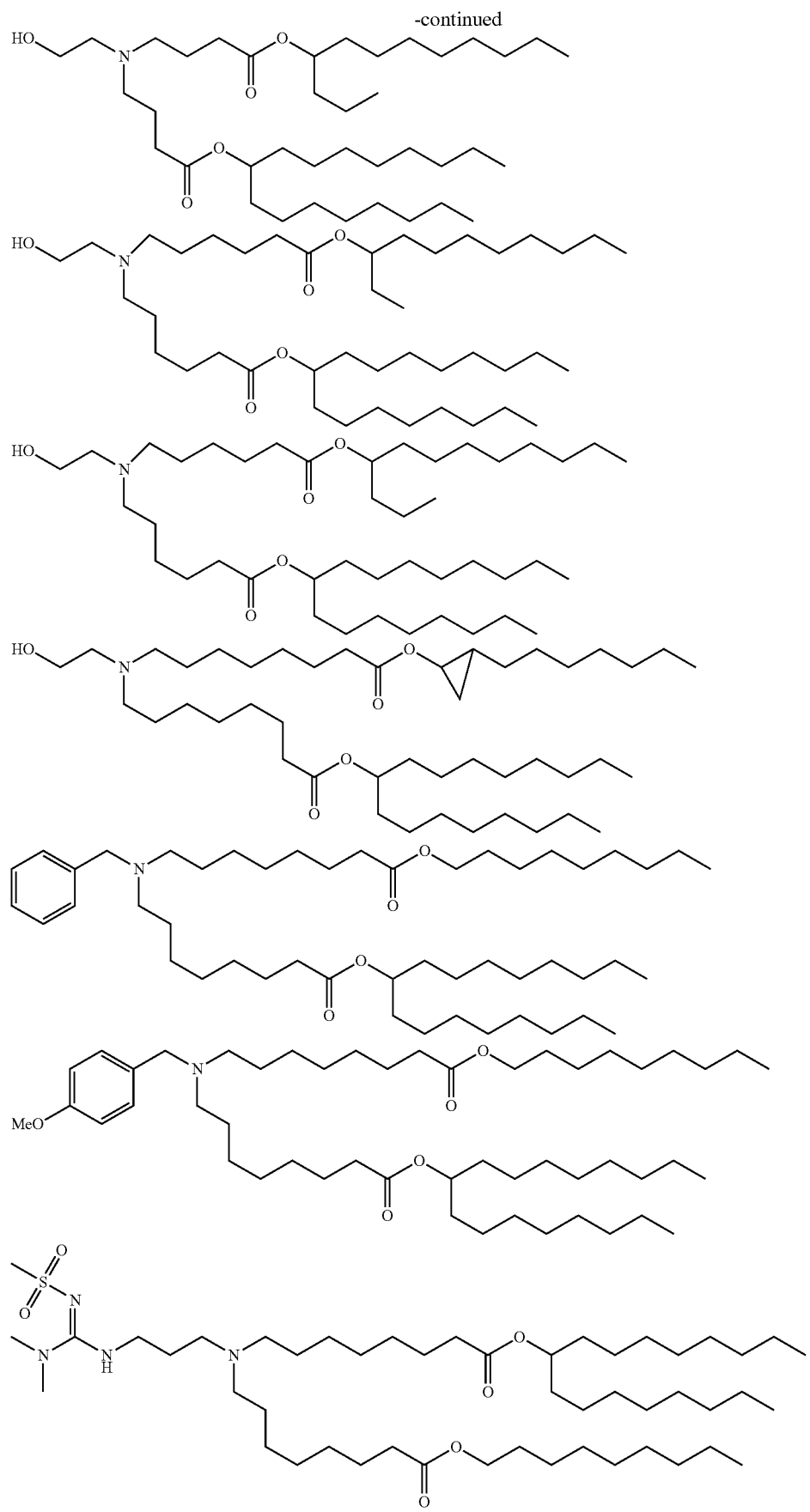

-continued
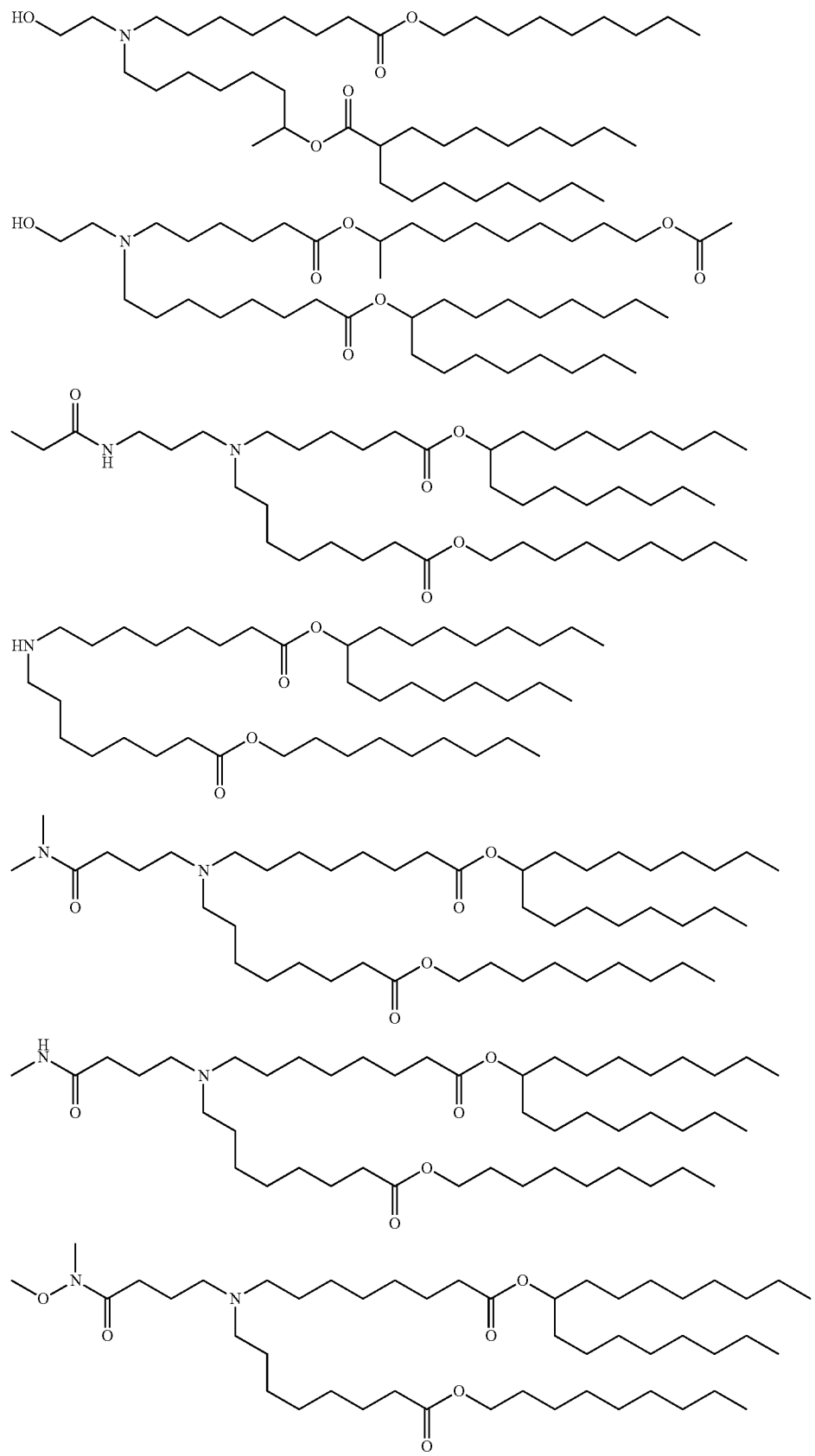

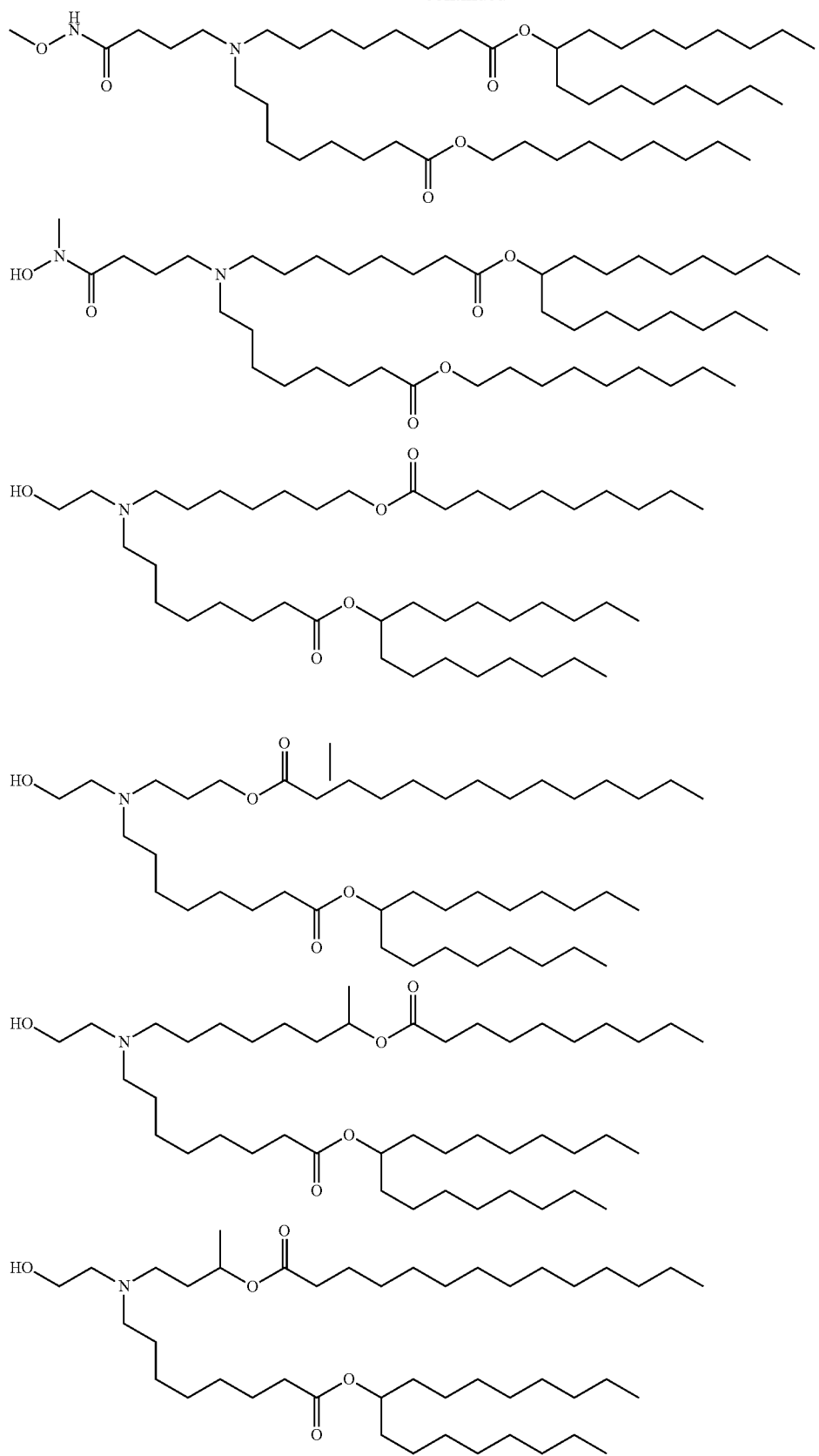

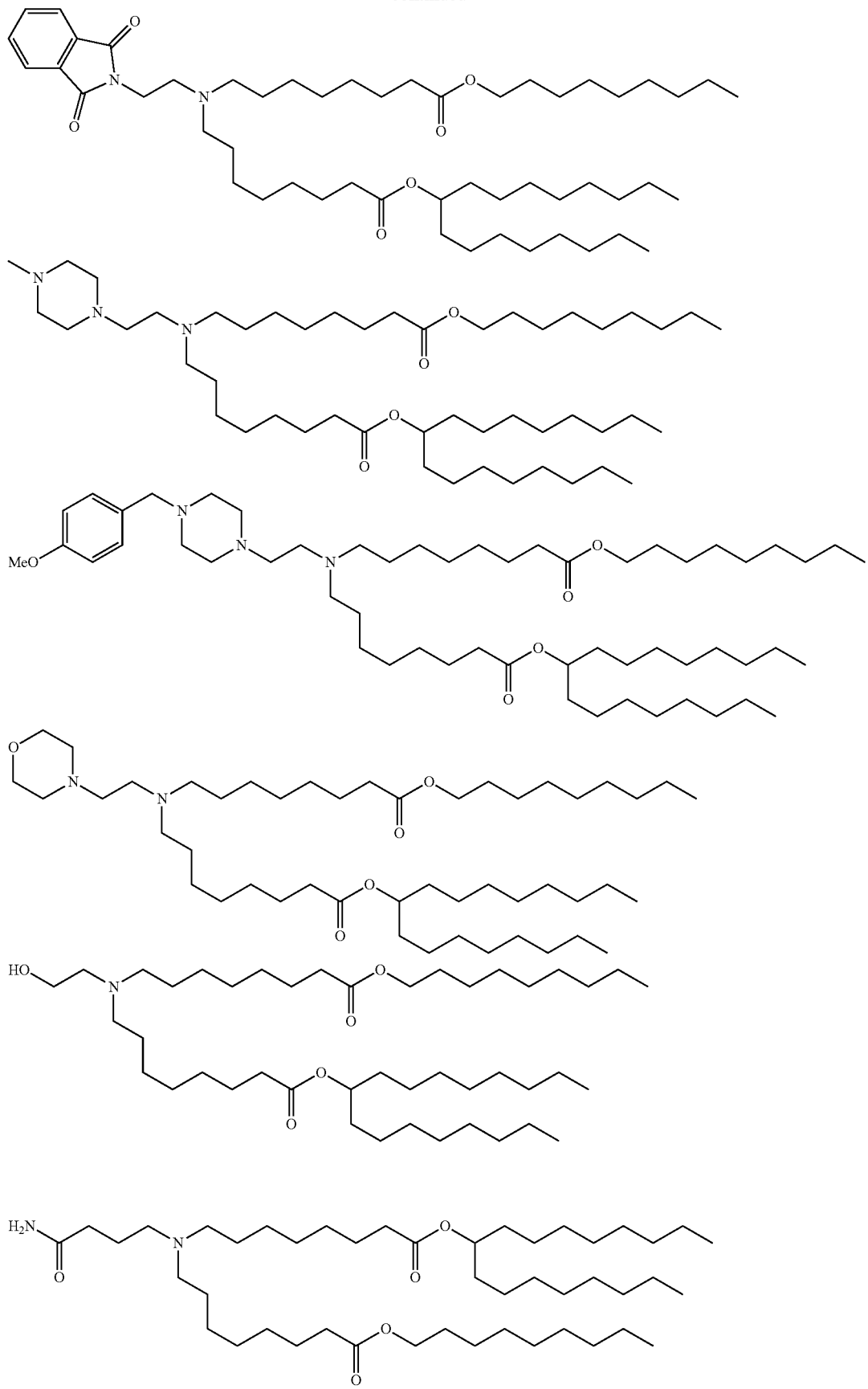

-continued
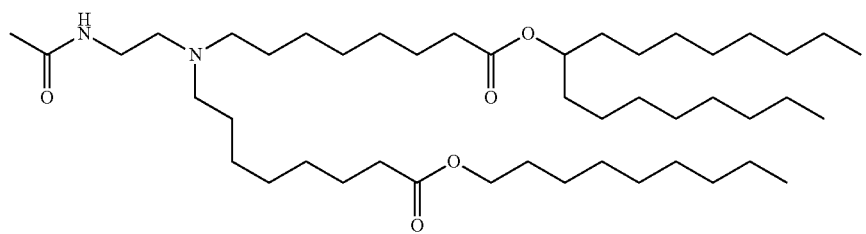
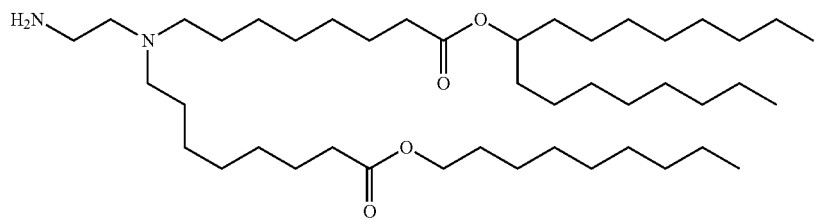
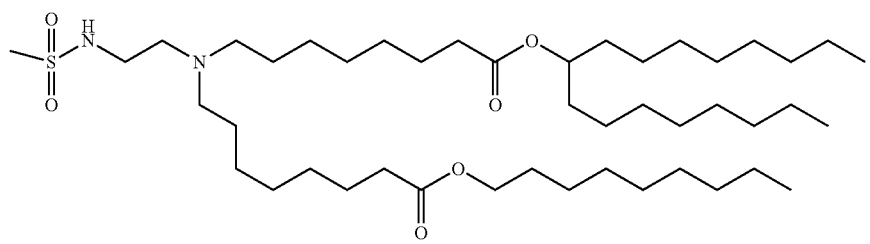
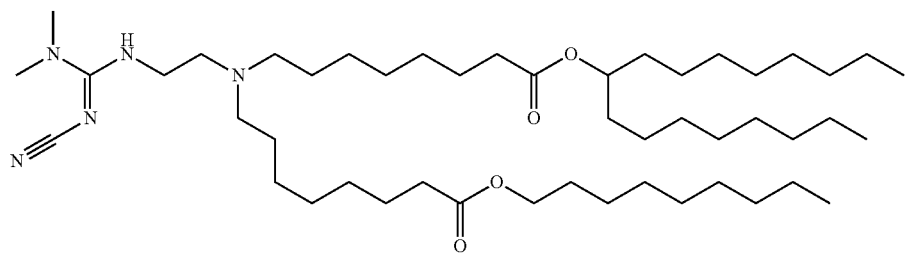
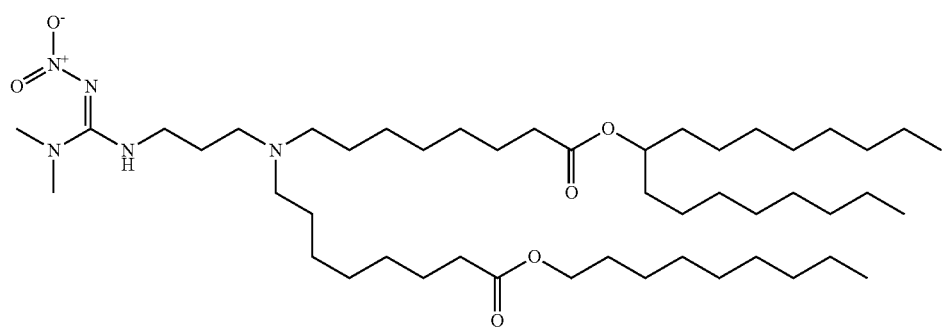
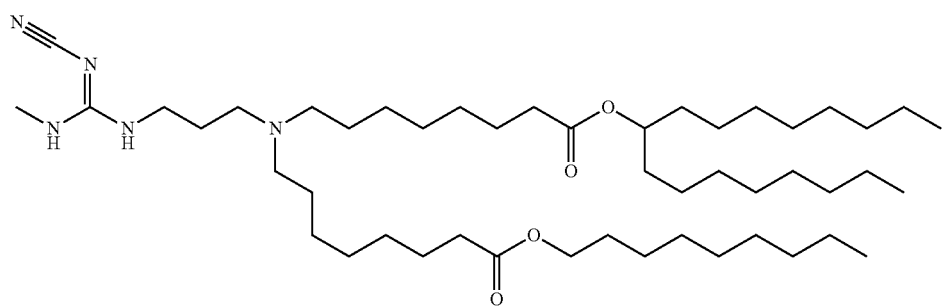

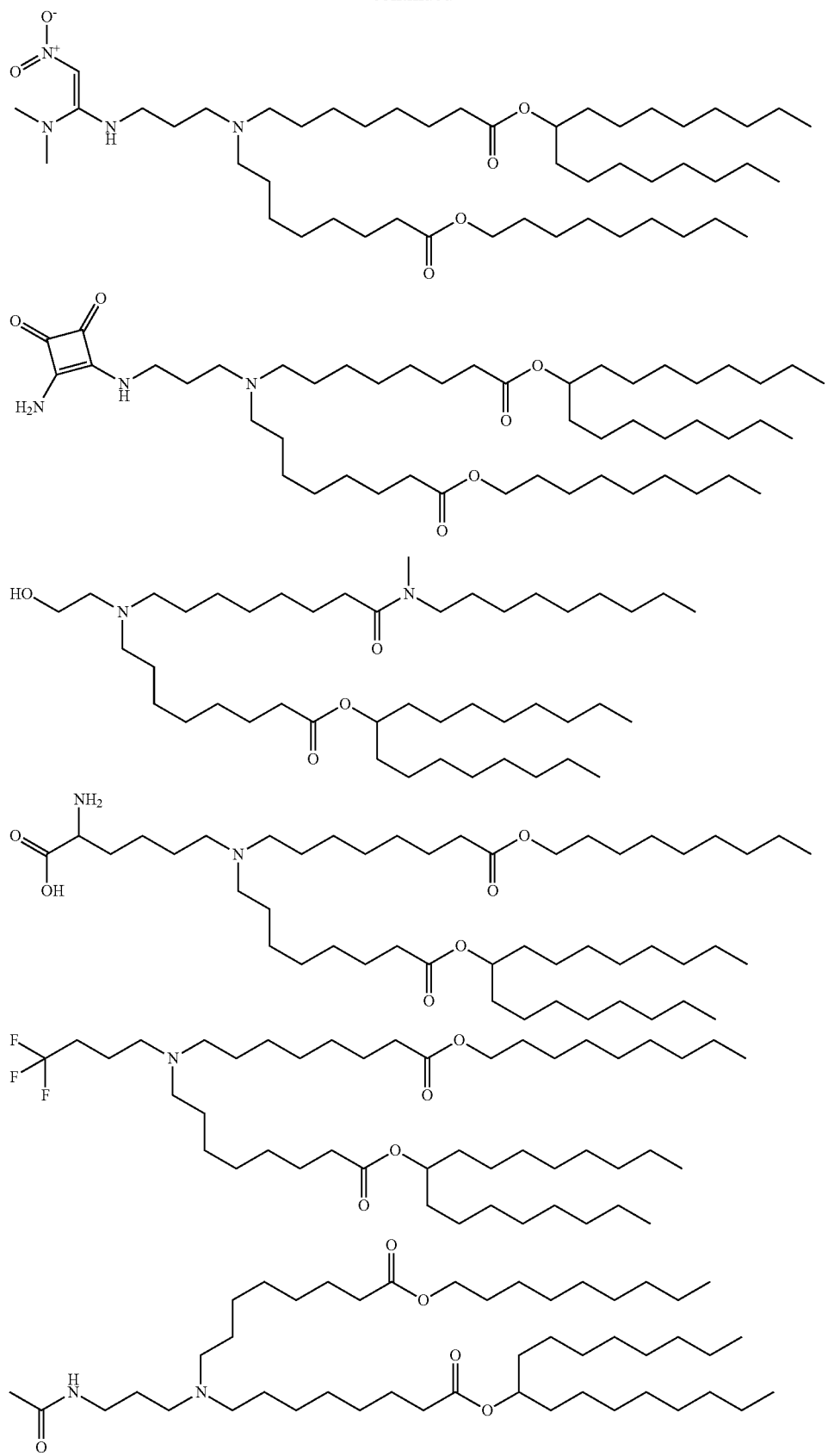

-continued
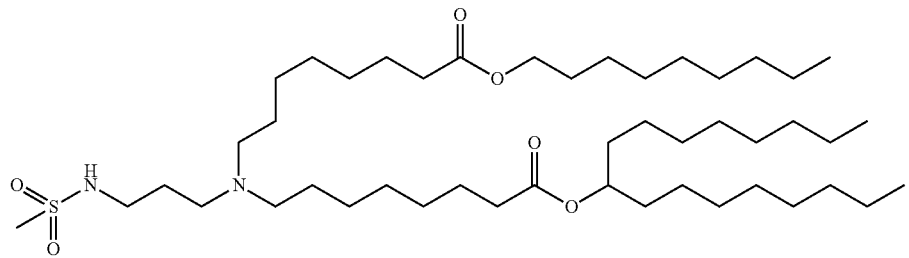
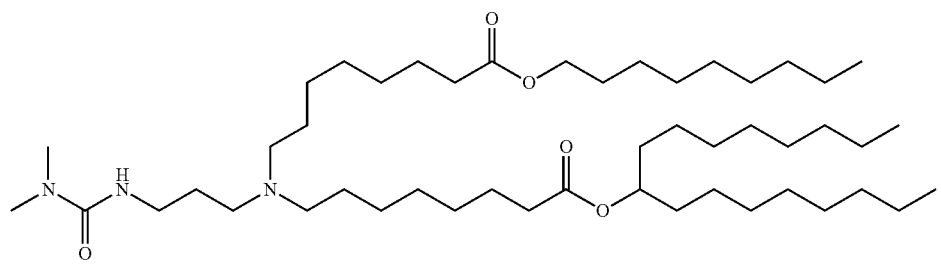
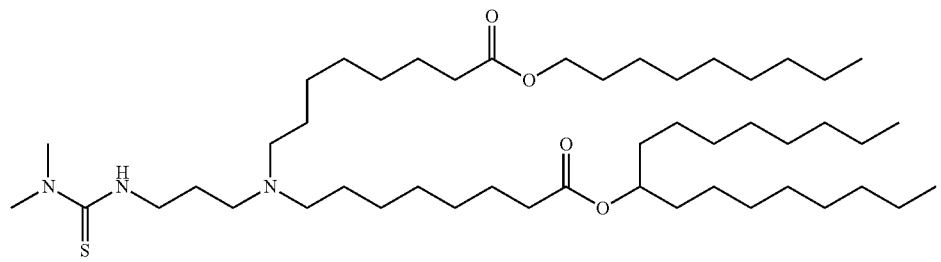
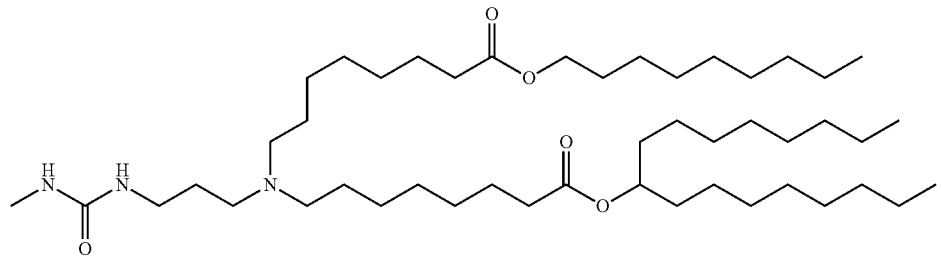
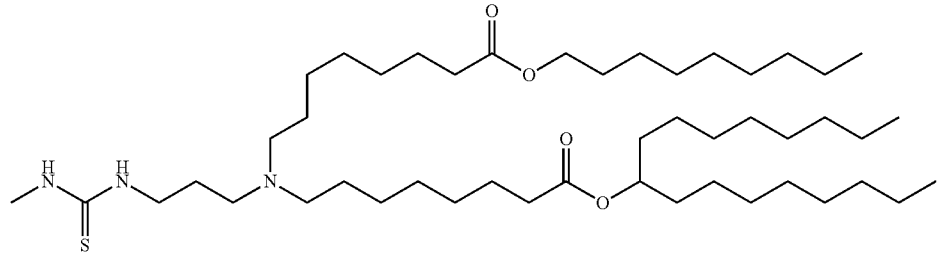
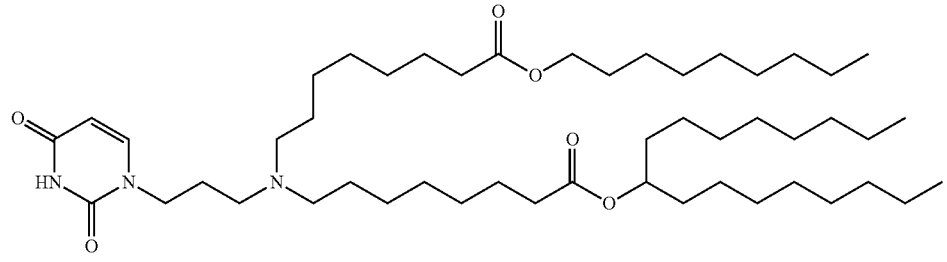

-continued
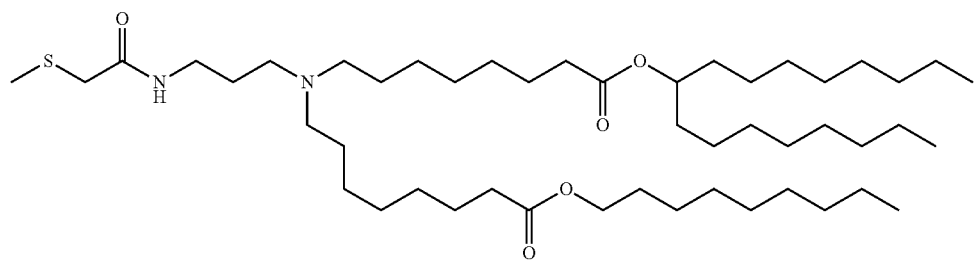
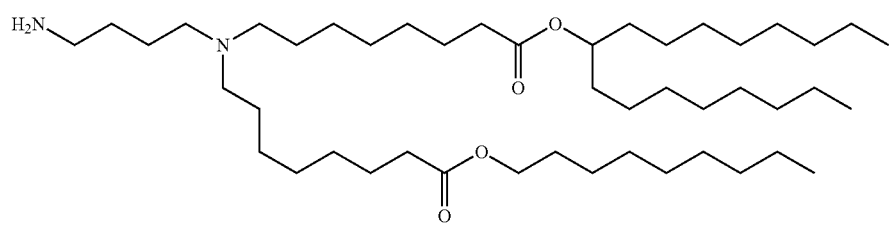
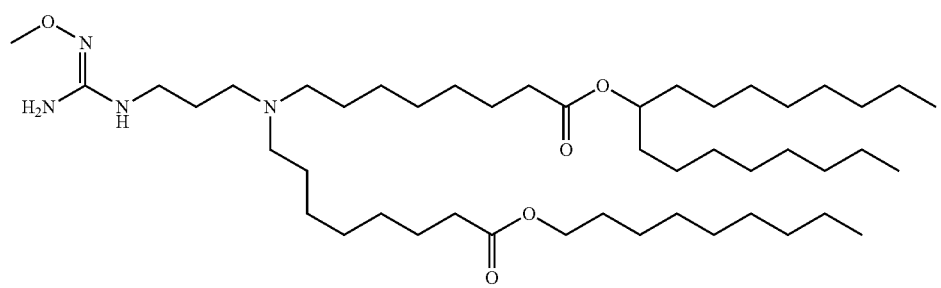
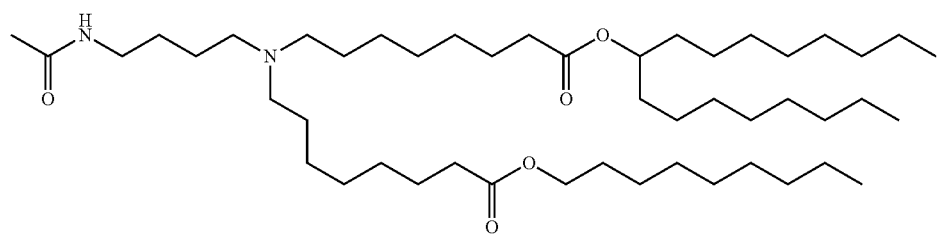
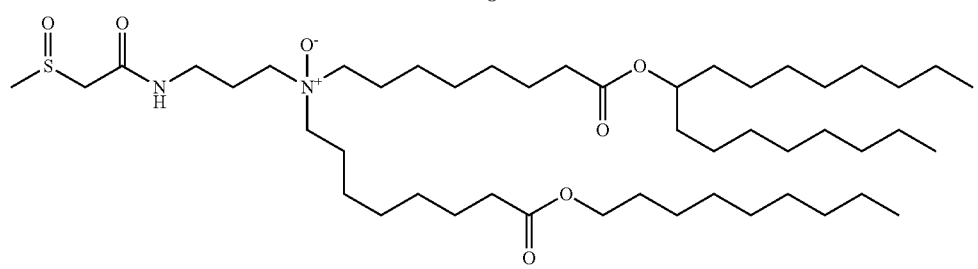
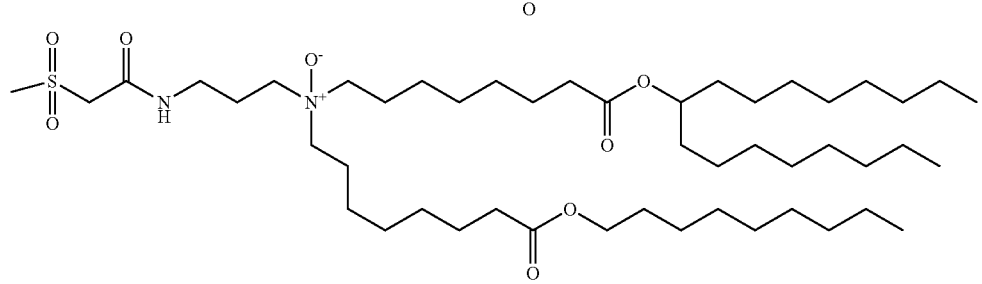

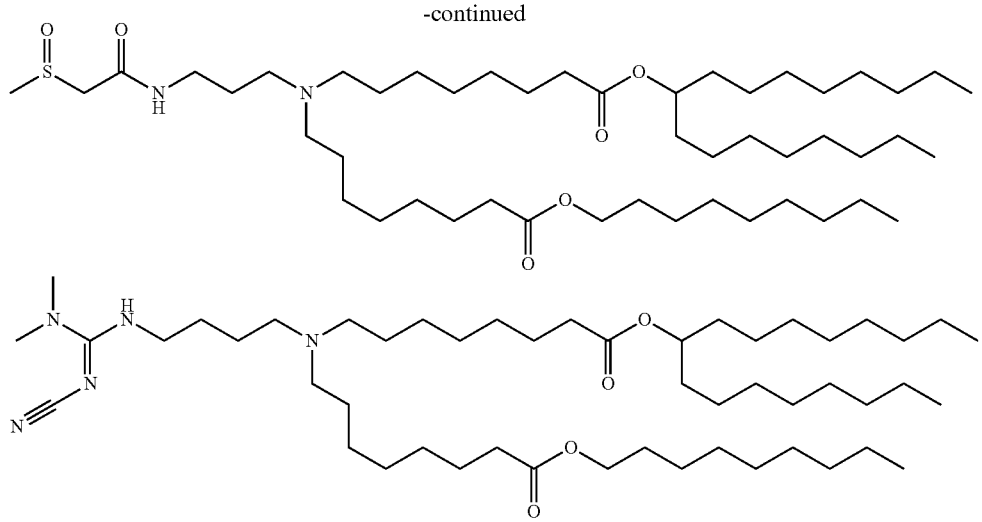

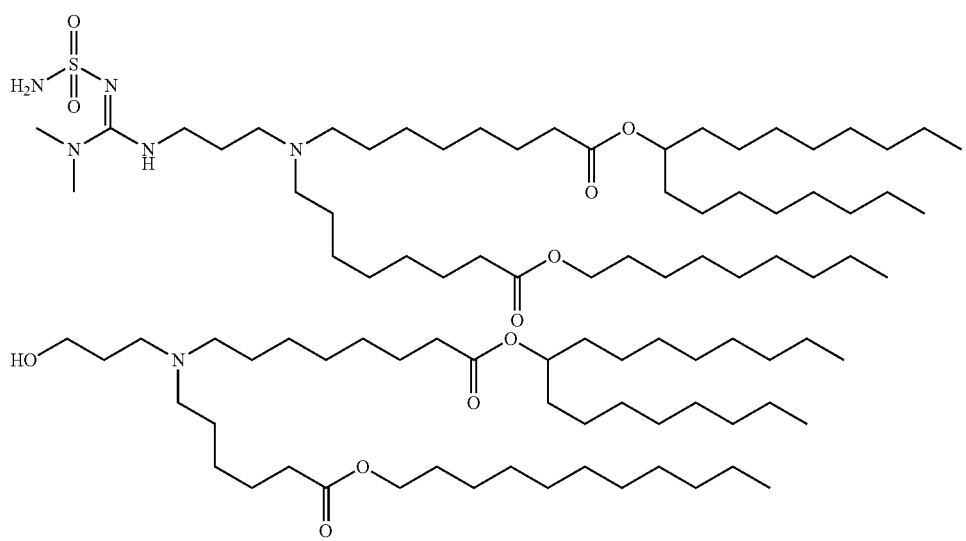

5.1 Amine Lipids

In certain embodiments, transfer vehicle compositions for the delivery of circular RNA comprise an amine lipid. In certain embodiments, an ionizable lipid is an amine lipid. In some embodiments, an amine lipid is described in international patent application PCT/US2018/053569.

In some embodiments, the amine lipid is Lipid E, which is (9Z,12Z)-3-((4,4-bis(octyloxy)butanoyl)oxy)-2-((((3-(diethylamino)propoxy)carbonyl)oxy)methyl)propyl octadeca-9, 12-dienoate.

Lipid E can be depicted as:

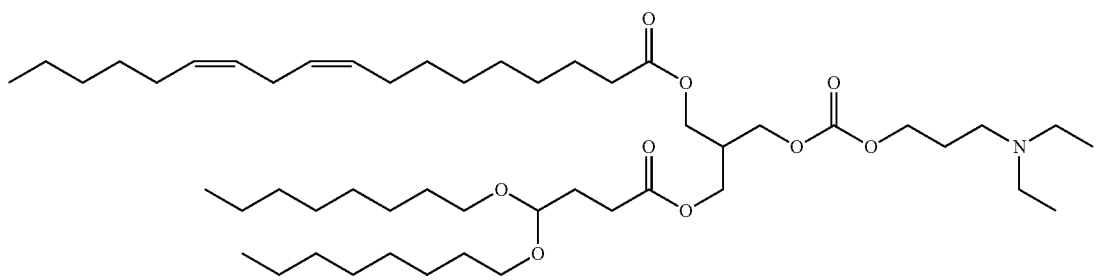 [SMILES: CCCCC/C=C\C/C=C\CCCCCCCC(=O)OCC(COC(=O)CCC(OCCCCCCCC)OCCCCCCCC)COC(=O)OCCCN(CC)CC]

Lipid E may be synthesized according to WO2015/095340 (e.g., pp. 84-86). In certain embodiments, the amine lipid is an equivalent to Lipid E.

In certain embodiments, an amine lipid is an analog of Lipid E. In certain embodiments, a Lipid E analog is an acetal analog of Lipid E. In particular transfer vehicle compositions, the acetal analog is a C4-C12 acetal analog. In some embodiments, the acetal analog is a C5-C12 acetal analog. In additional embodiments, the acetal analog is a C5-C10 acetal analog. In further embodiments, the acetal analog is chosen from a C4, C5, C6, C7, C9, C10, C11 and C12 acetal analog.

Amine lipids and other biodegradable lipids suitable for use in the transfer vehicles, e.g., lipid nanoparticles, described herein are biodegradable in vivo. The amine lipids described herein have low toxicity (e.g., are tolerated in animal models without adverse effect in amounts of greater than or equal to 10 mg/kg). In certain embodiments, transfer vehicles composing an amine lipid include those where at least 75% of the amine lipid is cleared from the plasma within 8, 10, 12, 24, or 48 hours, or 3, 4, 5, 6, 7, or 10 days.

Biodegradable lipids include, for example, the biodegradable lipids of WO2017/173054, WO2015/095340, and WO2014/136086.

Lipid clearance may be measured by methods known by persons of skill in the art. See, for example, Maier, M. A., et al. Biodegradable Lipids Enabling Rapidly Eliminated Lipid Nanoparticles for Systemic Delivery of RNAi Therapeutics. Mol. Ther. 2013, 21(8), 1570-78.

Transfer vehicle compositions comprising an amine lipid can lead to an increased clearance rate. In some embodiments, the clearance rate is a lipid clearance rate, for example the rate at which a lipid is cleared from the blood, serum, or plasma. In some embodiments, the clearance rate is an RNA clearance rate, for example the rate at which an circRNA is cleared from the blood, serum, or plasma. In some embodiments, the clearance rate is the rate at which transfer vehicles are cleared from the blood, serum, or plasma. In some embodiments, the clearance rate is the rate at which transfer vehicles are cleared from a tissue, such as liver tissue or spleen tissue. In certain embodiments, a high rate of clearance leads to a safety profile with no substantial adverse effects. The amine lipids and biodegradable lipids may reduce transfer vehicle accumulation in circulation and in tissues. In some embodiments, a reduction in transfer vehicle accumulation in circulation and in tissues leads to a safety profile with no substantial adverse effects.

Lipids may be ionizable depending upon the pH of the medium they are in. For example, in a slightly acidic medium, the lipid, such as an amine lipid, may be protonated and thus bear a positive charge. Conversely, in a slightly basic medium, such as, for example, blood, where pH is approximately 7.35, the lipid, such as an amine lipid, may not be protonated and thus bear no charge.

The ability of a lipid to bear a charge is related to its intrinsic pKa. In some embodiments, the amine lipids of the present disclosure may each, independently, have a pKa in the range of from about 5.1 to about 7.4. In some embodiments, the bioavailable lipids of the present disclosure may each, independently, have a pKa in the range of from about 5.1 to about 7.4. For example, the amine lipids of the present disclosure may each, independently, have a pKa in the range of from about 5.8 to about 6.5. Lipids with a pKa ranging from about 5.1 to about 7.4 are effective for delivery of cargo in vivo, e.g., to the liver. Further, it has been found that lipids with a pKa ranging from about 5.3 to about 6.4 are effective for delivery in vivo, e.g., into tumors. See, e.g., WO2014/136086.

5.2 Lipids Containing a Disulfide Bond

In some embodiments, the ionizable lipid is described in U.S. Pat. No. 9,708,628.

The present invention provides a lipid represented by structure (XXII):

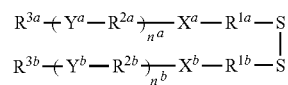

In structure (XXII), $X^a$ and $X^b$ are each independently $X^1$ or $X^2$ shown below.

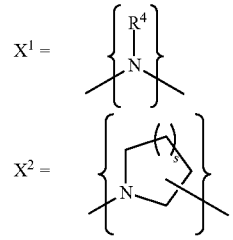

$R^4$ in $X^1$ is an alkyl group having 1-6 carbon atoms, which may be linear, branched or cyclic. The alkyl group preferably has a carbon number of 1-3. Specific examples of the alkyl group having 1-6 carbon atoms include methyl group, ethyl group, propyl group, isopropyl group, n-butyl group, sec-butyl group, isobutyl group, tert-butyl group, pentyl group, isopentyl group, neopentyl group, t-pentyl group, 1,2-dimethylpropyl group, 2-methylbutyl group, 2-methylpentyl group, 3-methylpentyl group, 2,2-dimethylbutyl group, 2,3-dimethylbutyl group, cyclohexyl group and the like. $R^4$ is preferably a methyl group, an ethyl group, a propyl group or an isopropyl group, most preferably a methyl group.

The s in $X^2$ is 1 or 2. When s is 1, $X^2$ is a pyrrolidinium group, and when s is 2, $X^2$ is a piperidinium group. s is preferably 2. While the binding direction of $X^2$ is not limited, a nitrogen atom in $X^2$ preferably binds to $R^{1a}$ and $R^{1b}$.

$X^a$ may be the same as or different from $X^b$, and $X^a$ is preferably the same group as $X^b$.

$n^a$ and $n^b$ are each independently 0 or 1, preferably 1. When $n^a$ is 1, $R^{3a}$ binds to $X^a$ via $Y^a$ and $R^{2a}$, and when $n^a$ is 0, a structure of $R^{3a}$—$X^a$—$R^{1a}$—S— is taken. Similarly, when $n^b$ is 1, $R^{3b}$ binds to $X^b$ via $Y^b$ and $R^{2b}$, and when $n^b$ is 0, a structure of $R^{3b}$—$X^b$—$R^{1b}$—S— is taken.

$n^a$ may be the same as or different from $n^b$, and $n^a$ is preferably the same as $n^b$.

$R^{1a}$ and $R^{1b}$ are each independently an alkylene group having 1-6 carbon atoms, which may be linear or branched, preferably linear. Specific examples of the alkylene group having 1-6 carbon atoms include methylene group, ethylene group, trimethylene group, isopropylene group, tetramethylene group, isobutylene group, pentamethylene group, neopentylene group and the like. $R^{1a}$ and $R^{1b}$ are each preferably a methylene group, an ethylene group, a trimethylene group, an isopropylene group or a tetramethylene group, most preferably an ethylene group.

$R^{1a}$ may be the same as or different from $R^{1b}$, and $R^{1a}$ is preferably the same group as $R^{1b}$.

$R^{2a}$ and $R^{2b}$ are each independently an alkylene group having 1-6 carbon atoms, which may be linear or branched, preferably linear. Examples of the alkylene group having 1-6 carbon atoms include those recited as the examples of the alkylene group having 1-6 carbon atoms for $R^{1a}$ or $R^{1b}$. $R^{2a}$ and $R^{2b}$ are each preferably a methylene group, an ethylene group, a trimethylene group, an isopropylene group or a tetramethylene group.

When $X^a$ and $X^b$ are each $X^1$, $R^{2a}$ and $R^{2b}$ are preferably trimethylene groups. When $X^a$ and $X^b$ are each $X^2$, $R^{2a}$ and $R^{2b}$ are preferably ethylene groups.

$R^{2a}$ may be the same as or different from $R^{2b}$, and $R^{2a}$ is preferably the same group as $R^{2b}$ $Y^a$ and $Y^b$ are each independently an ester bond, an amide bond, a carbamate bond, an ether bond or a urea bond, preferably an ester bond, an amide bond or a carbamate bond, most preferably an ester bond. While the binding direction of $Y^a$ and $Y^b$ is not limited, when $Y^a$ is an ester bond, a structure of $R^{3a}$—CO—O—$R^{2a}$— is preferable, and when $Y^b$ is an ester bond, a structure of $R^{3b}$—CO—O—$R^{2b}$— is preferable.

$Y^a$ may be the same as or different from $Y^b$, and $Y^a$ is preferably the same group as $Y^b$.

$R^{3a}$ and $R^{3b}$ are each independently a sterol residue, a liposoluble vitamin residue or an aliphatic hydrocarbon group having 12-22 carbon atoms, preferably a liposoluble vitamin residue or an aliphatic hydrocarbon group having 12-22 carbon atoms, most preferably a liposoluble vitamin residue.

Examples of the sterol residue include a cholesteryl group (cholesterol residue), a cholestaryl group (cholestanol residue), a stigmasteryl group (stigmasterol residue), a β-sitosteryl group (β-sitosterol residue), a lanosteryl group (lanosterol residue), and an ergosteryl group (ergosterol residue) and the like. The sterol residue is preferably a cholesteryl group or a cholestaryl group.

As the liposoluble vitamin residue, a residue derived from liposoluble vitamin, as well as a residue derived from a derivative obtained by appropriately converting a hydroxyl group, aldehyde or carboxylic acid, which is a functional group in liposoluble vitamin, to other reactive functional group can be used. As for liposoluble vitamin having a hydroxyl group, for example, the hydroxyl group can be converted to a carboxylic acid by reacting with succinic acid anhydride, glutaric acid anhydride and the like. Examples of the liposoluble vitamin include retinoic acid, retinol, retinal, ergosterol, 7-dehydrocholesterol, calciferol, cholecalciferol, dihydroergocalciferol, dihydrotachysterol, tocopherol, tocotrienol and the like. Preferable examples of the liposoluble vitamin include retinoic acid and tocopherol.

The aliphatic hydrocarbon group having 12-22 carbon atoms may be linear or branched, preferably linear. The aliphatic hydrocarbon group may be saturated or unsaturated. In the case of an unsaturated aliphatic hydrocarbon group, the aliphatic hydrocarbon group generally contains 1-6, preferably 1-3, more preferably 1-2 unsaturated bonds. While the unsaturated bond includes a carbon-carbon double bond and a carbon-carbon triple bond, it is preferably a carbon-carbon double bond. The aliphatic hydrocarbon group has a carbon number of preferably 12-18, most preferably 13-17. While the aliphatic hydrocarbon group includes an alkyl group, an alkenyl group, an alkynyl group and the like, it is preferably an alkyl group or an alkenyl group. Specific examples of the aliphatic hydrocarbon group having 12-22 carbon atoms include dodecyl group, tridecyl group, tetradecyl group, pentadecyl group, hexadecyl group, heptadecyl group, octadecyl group, nonadecyl group, icosyl group, henicosyl group, docosyl group, dodecenyl group, tridecenyl group, tetradecenyl group, pentadecenyl group, hexadecenyl group, heptadecenyl group, octadecenyl group, nonadecenyl group, icosenyl group, henicosenyl group, docosenyl group, decadienyl group, tridecadienyl group, tetradecadienyl group, pentadecadienyl group, hexadecadienyl group, heptadecadienyl group, octadecadienyl group, nonadecadienyl group, icosadienyl group, henicosadienyl group, docosadienyl group, octadecatrienyl group, icosatrienyl group, icosatetraenyl group, icosapentaenyl group, docosahexaenyl group, isostearyl group and the like. The aliphatic hydrocarbon group having 12-22 carbon atoms is preferably tridecyl group, tetradecyl group, heptadecyl group, octadecyl group, heptadecadienyl group or octadecadienyl group, particularly preferably tridecyl group, heptadecyl group or heptadecadienyl group.

In one embodiment, an aliphatic hydrocarbon group having 12-22 carbon atoms, which is derived from fatty acid, aliphatic alcohol, or aliphatic amine is used. When $R^{3a}$ (or $R^{3b}$) is derived from fatty acid, $Y^a$ (or $Y^b$) is an ester bond or an amide bond, and fatty acid-derived carbonyl carbon is included in $Y^a$ (or $Y^b$). For example, when linoleic acid is used, $R^{3a}$ (or $R^{3b}$) is a heptadecadienyl group.

$R^{3a}$ may be the same as or different from $R^{3b}$, and $R^{3a}$ is preferably the same group as $R^{3b}$.

In one embodiment, $X^a$ is the same as $X^b$, $n^a$ is the same as $n^b$, $R^{1a}$ is the same as $R^{1b}$, $R^{2a}$ is the same as $R^{2b}$, $R^{3a}$ is the same as $R^{3b}$, and $Y^a$ is the same as $Y^b$.

In one embodiment,
$X^a$ and $X^b$ are each independently X1,
$R^4$ is an alkyl group having 1-3 carbon atoms, $n^a$ and $n^b$ are each 1,
$R^{1a}$ and $R^{1b}$ are each independently an alkylene group having 1-6 carbon atoms,
$R^{2a}$ and $R^{2b}$ are each independently an alkylene group having 1-6 carbon atoms,
$Y^a$ and $Y^b$ are each an ester bond or an amide bond, and
$R^{3a}$ and $R^{3b}$ are each independently an aliphatic hydrocarbon group having 12-22 carbon atoms.

In one embodiment,
$X^a$ and $X^b$ are each X1,
$R^4$ is an alkyl group having 1-3 carbon atoms, $n^a$ and $n^b$ are each 1,
$R^{1a}$ and $R^{1b}$ are each an alkylene group having 1-6 carbon atoms,
$R^{2a}$ and $R^{2b}$ are each an alkylene group having 1-6 carbon atoms,
$Y^a$ and $Y^b$ are each an ester bond or an amide bond,
$R^{3a}$ and $R^{3b}$ are each an aliphatic hydrocarbon group having 12-22 carbon atoms,
$X^a$ is the same as $X^b$,
$R^{1a}$ is the same as $R^{1b}$,
$R^{2a}$ is the same as $R^{2b}$, and
$R^{3a}$ is the same as $R^{3b}$.

In one embodiment,
$X^a$ and $X^b$ are each $X^1$,
$R^4$ is a methyl group, $n^a$ and $n^b$ are each 1,
$R^{1a}$ and $R^{1b}$ are each an ethylene group,
$R^{2a}$ and $R^{2b}$ are each a trimethylene group,
$Y^a$ and $Y^b$ are each —CO—O—, and
$R^{3a}$ and $R^{3b}$ are each independently an alkyl group or alkenyl group having 13-17 carbon atoms.

In one embodiment,
$X^a$ and $X^b$ are each $X^1$,
$R^4$ is a methyl group, $n^a$ and $n^b$ are each 1, $R^{1a}$ and $R^{1b}$ are each an ethylene group,
$R^{2a}$ and $R^{2b}$ are each a trimethylene group,
$Y^a$ and $Y^b$ are each CO O,
$R^{3a}$ and $R^{3b}$ are each an alkyl group or alkenyl group having 13-17 carbon atoms, and
$R^{3a}$ is the same as $R^{3b}$.
In one embodiment,
$X^a$ and $X^b$ are each independently $X^1$,
$R^4$ is an alkyl group having 1-3 carbon atoms, $n^a$ and $n^b$ are each 1,
$R^{1a}$ and $R^{1b}$ are each independently an alkylene group having 1-6 carbon atoms,
$R^{2a}$ and $R^{2b}$ are each independently an alkylene group having 1-6 carbon atoms,
$Y^a$ and $Y^b$ are each an ester bond or an amide bond, and
$R^{3a}$ and $R^{3b}$ are each independently a liposoluble vitamin residue (e.g., retinoic acid residue, tocopherol residue).
In one embodiment,
$X^a$ and $X^b$ are each $X^1$,
$R^4$ is an alkyl group having 1-3 carbon atoms, $n^a$ and $n^b$ are each 1,
$R^{1a}$ and $R^{1b}$ are each an alkylene group having 1-6 carbon atoms,
$R^{2a}$ and $R^{2b}$ are each an alkylene group having 1-6 carbon atoms,
$Y^a$ and $Y^b$ are each an ester bond or an amide bond,
$R^{3a}$ and $R^{3b}$ are each a liposoluble vitamin residue (e.g., retinoic acid residue, tocopherol residue),
$X^a$ is the same as $X^b$,
$R^{1a}$ is the same as $R^{1b}$,
$R^{2a}$ is the same as $R^{2b}$, and
$R^{3a}$ is the same as $R^{3b}$.
In one embodiment,
$X^a$ and $X^b$ are each $X^1$,
$R^4$ is a methyl group, $n^a$ and $n^b$ are each 1,
$R^{1a}$ and $R^{1b}$ are each an ethylene group,
$R^{2a}$ and $R^{2b}$ are each a trimethylene group,
$Y^a$ and $Y^b$ are each CO—O—, and
$R^{3a}$ and $R^{3b}$ are each independently a liposoluble vitamin residue (e.g., retinoic acid residue, tocopherol residue).
In one embodiment,
$X^a$ and $X^b$ are each $X^1$,
$R^4$ is a methyl group, $n^a$ and $n^b$ are each 1,
$R^{1a}$ and $R^{1b}$ are each an ethylene group,
$R^{2a}$ and $R^{2b}$ are each a trimethylene group,
$Y^a$ and $Y^b$ are each CO 0,
$R^{3a}$ and $R^{3b}$ are each a liposoluble vitamin residue (e.g., retinoic acid residue, tocopherol residue), and
$R^{3a}$ is the same as $R^{3b}$.
In one embodiment,
$X^a$ and $X^b$ are each independently $X^2$,
t is 2,
$R^{1a}$ and $R^{1b}$ are each independently an alkylene group having 1-6 carbon atoms,
$R^{2a}$ and $R^{2b}$ are each independently an alkylene group having 1-6 carbon atoms,
$Y^a$ and $Y^b$ are each an ester bond, and
$R^{3a}$ and $R^{3b}$ are each independently a liposoluble vitamin residue (e.g., retinoic acid residue, tocopherol residue) or an aliphatic hydrocarbon group having 12-22 carbon atoms (e.g., alkyl group having 12-22 carbon atoms).
In one embodiment,
$X^a$ and $X^b$ are each independently $X^2$,
t is 2,
$R^{1a}$ and $R^{1b}$ are each independently an alkylene group having 1-6 carbon atoms,
$R^{2a}$ and $R^{2b}$ are each independently an alkylene group having 1-6 carbon atoms,
$Y^a$ and $Y^b$ are each an ester bond,
$R^{3a}$ and $R^{3b}$ are each independently a liposoluble vitamin residue (e.g., retinoic acid residue, tocopherol residue) or an aliphatic hydrocarbon group having 12-22 carbon atoms (e.g., alkyl group having 12-22 carbon atoms),
$X^a$ is the same as $X^b$,
$R^{1a}$ is the same as $R^{1b}$,
$R^{2a}$ is the same as $R^{2b}$, and
$R^{3a}$ is the same as $R^{3b}$.
In one embodiment,
$X^a$ and $X^b$ are each independently $X^2$,
t is 2,
$R^{1a}$ and $R^{1b}$ are each an ethylene group,
$R^{2a}$ and $R^{2b}$ are each independently an alkylene group having 1-6 carbon atoms,
$Y^a$ and $Y^b$ are each an ester bond,
$R^{3a}$ and $R^{3b}$ are each independently a liposoluble vitamin residue (e.g., retinoic acid residue, tocopherol residue) or an aliphatic hydrocarbon group having 12-22 carbon atoms (e.g., alkyl group having 12-22 carbon atoms),
$X^a$ is the same as $X^b$,
$R^{2a}$ is the same as $R^{2b}$, and
$R^{3a}$ is the same as $R^{3b}$.
In some embodiments, an ionizable lipid has one of the structures set forth in Table 15b below.

TABLE 15b

| Number | Structure |
|---|---|
| 1 | 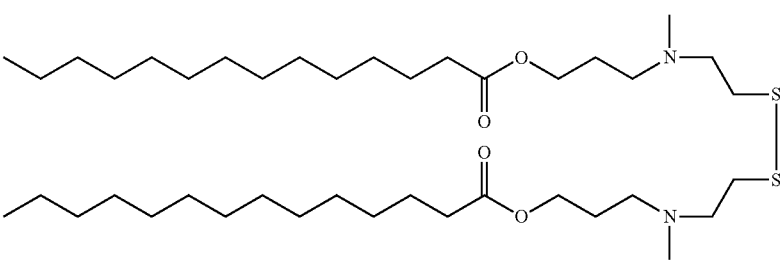 [SMILES: CCCCCCCCCCCCCC(=O)OCCCN(C)CCSCSCCN(C)CCCOC(=O)CCCCCCCCCCCCC] |

TABLE 15b-continued

| Number | Structure |
|---|---|
| 2 | 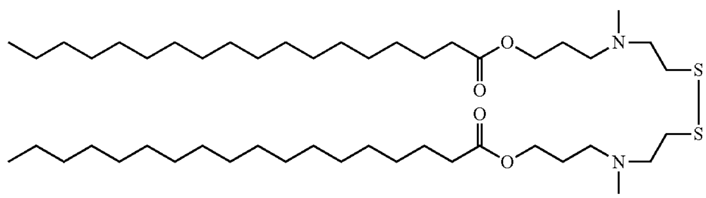 [SMILES: CCCCCCCCCCCCCCCCCC(=O)OCCCN(C)CCSCSCCN(C)CCCOC(=O)CCCCCCCCCCCCCCCCC] |
| 3 | 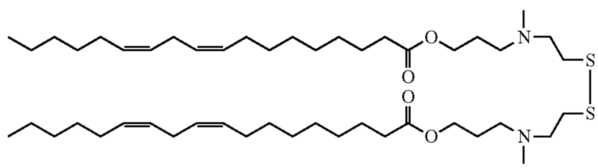 [SMILES: CCCCC/C=C\C/C=C\CCCCCCCC(=O)OCCCN(C)CCSCSCCN(C)CCCOC(=O)CCCCCCC/C=C\C/C=C\CCCCC] |
| 4 | 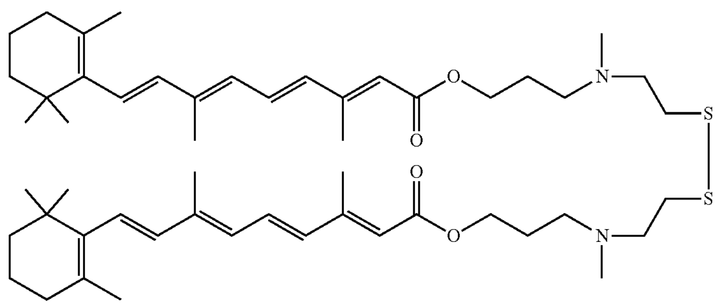 [SMILES: CC1=C(/C=C/C(C)=C/C=C/C(C)=C/C(=O)OCCCN(C)CCSCSCCN(C)CCCOC(=O)/C=C(C)/C=C/C=C(C)/C=C/C2=C(C)CCCC2(C)C)C(C)(C)CCC1] |
| 5 | 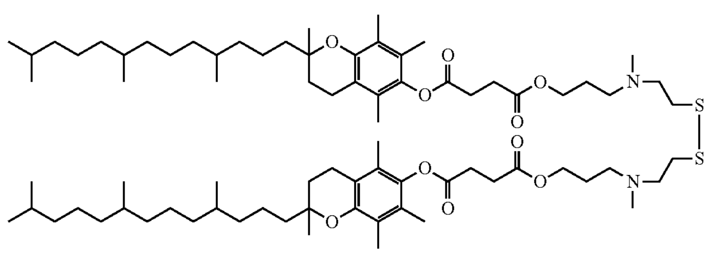 [SMILES: Cc1c(C)c2c(c(C)c1OC(=O)CCC(=O)OCCCN(C)CCSCSCCN(C)CCCOC(=O)CCC(=O)Oc1c(C)c(C)c3c(c1C)CCC(C)(CCCC(C)CCCC(C)CCCC(C)C)O3)CCC(C)(CCCC(C)CCCC(C)CCCC(C)C)O2] |
| 6 | 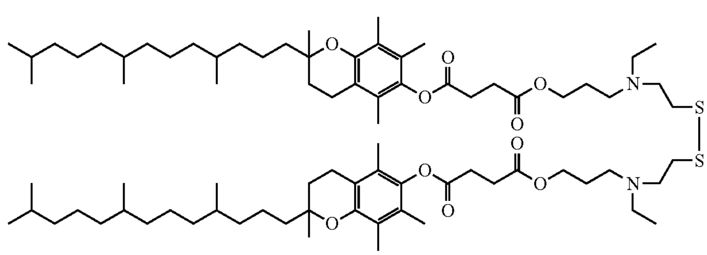 [SMILES: CCN(CCCOC(=O)CCC(=O)Oc1c(C)c(C)c2c(c1C)CCC(C)(CCCC(C)CCCC(C)CCCC(C)C)O2)CCSCSCCN(CC)CCCOC(=O)CCC(=O)Oc1c(C)c(C)c2c(c1C)CCC(C)(CCCC(C)CCCC(C)CCCC(C)C)O2] |
| 7 | 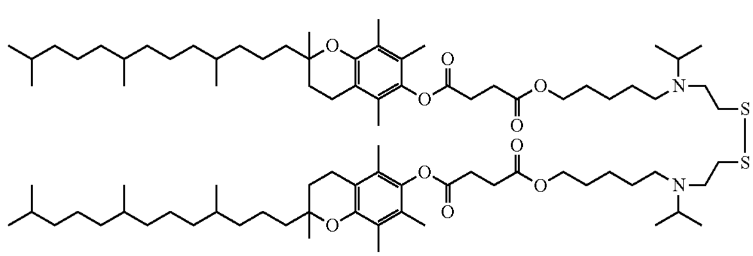 [SMILES: Cc1c(C)c2c(c(C)c1OC(=O)CCC(=O)OCCCCCN(CCSCSCCN(CCCCCOC(=O)CCC(=O)Oc1c(C)c(C)c3c(c1C)CCC(C)(CCCC(C)CCCC(C)CCCC(C)C)O3)C(C)C)C(C)C)CCC(C)(CCCC(C)CCCC(C)CCCC(C)C)O2] |

TABLE 15b-continued
| Number | Structure |
|---|---|
| 8 | 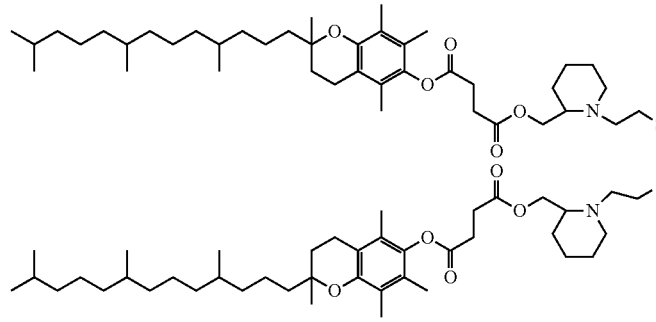 |
| 9 | 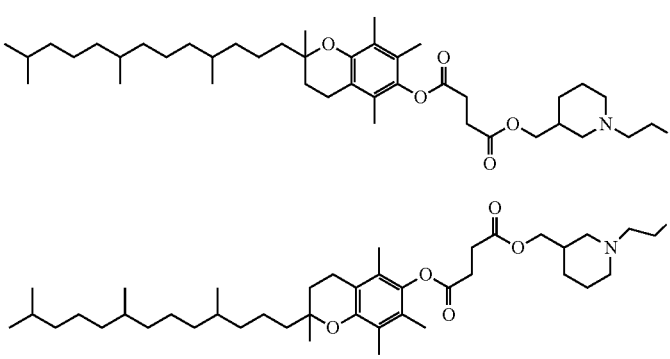 |
| 10 | 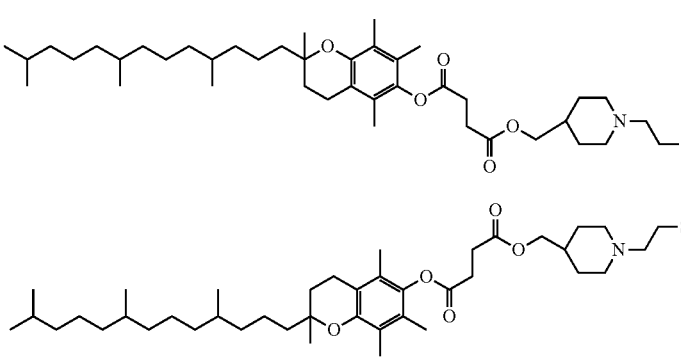 |
| 11 | 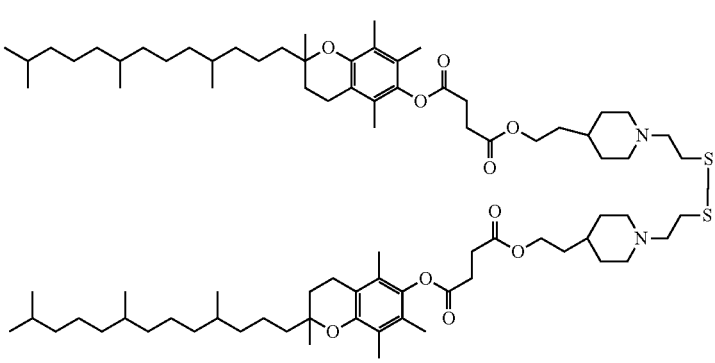 [SMILES: Cc1c(C)c2c(c(C)c1OC(=O)CCC(=O)OCCC1CCN(CCSSCCN3CCC(CCOC(=O)CCC(=O)Oc4c(C)c(C)c5c(c4C)CCC(C)(CCCC(C)CCCC(C)CCCC(C)C)O5)CC3)CC1)CCC(C)(CCCC(C)CCCC(C)CCCC(C)C)O2] |

TABLE 15b-continued

| Number | Structure |
|---|---|
| 12 | 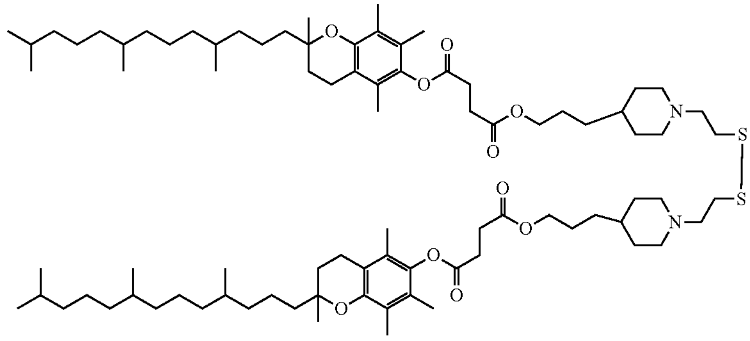 [SMILES: Cc1c(C)c2c(c(C)c1OC(=O)CCC(=O)OCCCC1CCN(CCSSCCN3CCC(CCCOC(=O)CCC(=O)Oc4c(C)c(C)c5c(c4C)CCC(C)(CCCC(C)CCCC(C)CCCC(C)C)O5)CC3)CC1)CCC(C)(CCCC(C)CCCC(C)CCCC(C)C)O2] |
| 13 | 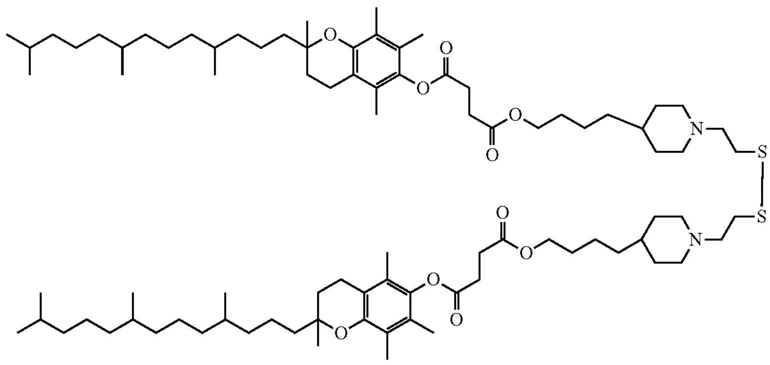 [SMILES: Cc1c(C)c2c(c(C)c1OC(=O)CCC(=O)OCCCCC1CCN(CCSSCCN3CCC(CCCCOC(=O)CCC(=O)Oc4c(C)c(C)c5c(c4C)CCC(C)(CCCC(C)CCCC(C)CCCC(C)C)O5)CC3)CC1)CCC(C)(CCCC(C)CCCC(C)CCCC(C)C)O2] |
| 14 | 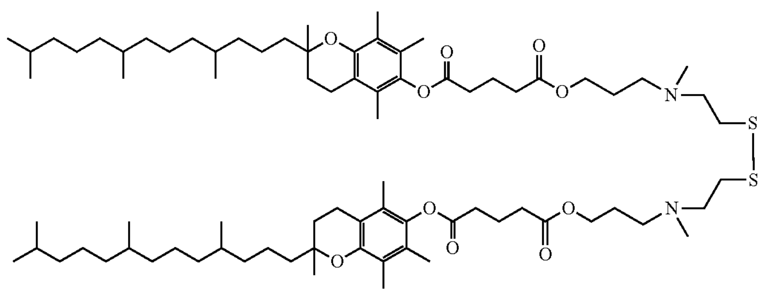 [SMILES: Cc1c(C)c2c(c(C)c1OC(=O)CCCC(=O)OCCCN(C)CCSSCCN(C)CCCOC(=O)CCCC(=O)Oc1c(C)c(C)c3c(c1C)CCC(C)(CCCC(C)CCCC(C)CCCC(C)C)O3)CCC(C)(CCCC(C)CCCC(C)CCCC(C)C)O2] |
| 15 | 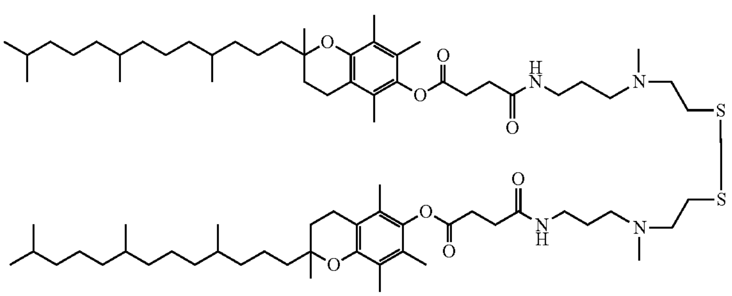 [SMILES: Cc1c(C)c2c(c(C)c1OC(=O)CCC(=O)NCCCN(C)CCSSCCN(C)CCCNC(=O)CCC(=O)Oc1c(C)c(C)c3c(c1C)CCC(C)(CCCC(C)CCCC(C)CCCC(C)C)O3)CCC(C)(CCCC(C)CCCC(C)CCCC(C)C)O2] |

A lipid of the present invention may have an —S—S— (disulfide) bond. The production method for such a compound includes, for example, a method including producing $R^{3a}$—($Y^a$—$R^{2a}$)n$^a$-$X^a$—$R^{1a}$—SH, and $R^{3b}$—($Y^b$—$R^{2b}$)n$^b$-$X^b$—$R^{1b}$—SH, and subjecting them to oxidation (coupling) to give a compound containing —S—S—, a method including sequentially bonding necessary parts to a compound containing an —S—S— bond to finally obtain the compound of the present invention and the like. Preferred is the latter method.

A specific example of the latter method is shown below, which is not to be construed as limiting.

Examples of the starting compound include —S—S— bond-containing two terminal carboxylic acid, two terminal carboxylate, two terminal amine, two terminal isocyanate, two terminal alcohol, two terminal alcohol having a leaving group such as MsO (mesylate group) and the like, a two terminal carbonate having a leaving group such as pNP (p-nitrophenylcarbonate group) and the like.

For example, when a compound containing $X^1$ or $X^2$ for $X^a$ and $X^b$ is produced, two terminal functional groups of compound (1) containing an —S—S— bond are reacted with an —NH— group in compound (2) having the —NH— group and one functional group at the terminal, the functional group at the terminal in compound (2) which did not contribute to the reaction is reacted with a functional group in compound (3) containing $R^3$, whereby the compound of the present invention containing an —S—S— bond, $R^{1a}$ and $R^{1b}$, $X^a$ and $X^b$, $R^{2a}$ and $R^{2b}$, $Y^a$ and $Y^b$, and $R^{3a}$ and $R^{3b}$ can be obtained.

In the reaction of compound (1) and compound (2), an alkali catalyst such as potassium carbonate, sodium carbonate, potassium t-butoxide and the like may be used as a catalyst, or the reaction may be performed without a catalyst. Preferably, potassium carbonate or sodium carbonate is used as a catalyst.

The amount of catalyst is 0.1-100 molar equivalents, preferably, 0.1-20 molar equivalents, more preferably 0.1-5 molar equivalents, relative to compound (1). The amount of compound (2) to be charged is 1-50 molar equivalents, preferably 1-10 molar equivalents, relative to compound (1).

The solvent to be used for the reaction of compound (1) and compound (2) is not particularly limited as long as it is a solvent or aqueous solution that does not inhibit the reaction. For example, ethyl acetate, dichloromethane, chloroform, benzene, toluene and the like can be mentioned. Among these, toluene and chloroform are preferable.

The reaction temperature is −20 to 200° C., preferably 0 to 80° C., more preferably 20 to 50° C., and the reaction time is 1-48 hr, preferably 2-24 hr.

When the reaction product of compound (1) and compound (2) is reacted with compound (3), an alkali catalyst such as potassium carbonate, sodium carbonate, potassium t-butoxide and the like, or an acid catalyst such as PTS (p-toluenesulfonic acid), MSA (methanesulfonic acid) and the like may be used, like the catalyst used for the reaction of compound (1) and compound (2), or the reaction may be performed without a catalyst.

In addition, the reaction product of compound (1) and compound (2) may be directly reacted with compound (3) by using a condensing agent such as DCC (dicyclohexylcarbodiimide), DIC (diisopropylcarbodiimide), EDC (1-ethyl-3-(3-dimethylaminopropyl)carbodiimide hydrochloride) and the like. Alternatively, compound (3) may be treated with a condensing agent to be once converted to an anhydride and the like, after which it is reacted with the reaction product of compound (1) and compound (2).

The amount of compound (3) to be charged is 1-50 molar equivalents, preferably 1-10 molar equivalents, relative to the reaction product of compound (1) and compound (2).

The catalyst to be used is appropriately selected according to the functional groups to be reacted.

The amount of catalyst is 0.05-100 molar equivalents, preferably 0.1-20 molar equivalents, more preferably 0.2-5 molar equivalent, relative to compound (1).

The solvent to be used for the reaction of the reaction product of compound (1) and compound (2) with compound (3) is not particularly limited as long as it is a solvent or aqueous solution that does not inhibit the reaction. For example, ethyl acetate, dichloromethane, chloroform, benzene, toluene and the like can be mentioned. Among these, toluene and chloroform are preferable.

The reaction temperature is 0 to 200° C., preferably 0 to 120° C., more preferably 20 to 50° C., and the reaction time is 1 hr-48 hr, preferably 2-24 hr.

The reaction product obtained by the above-mentioned reaction can be appropriately purified by a general purification method, for example, washing with water, silica gel column chromatography, crystallization, recrystallization, liquid-liquid extraction, reprecipitation, ion exchange column chromatography and the like.

5.3 Structure XXIII Lipids

In some embodiments, an ionizable lipid is described in U.S. Pat. No. 9,765,022.

The present invention provides a compound represented by structure (XXIII):

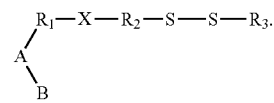

In structure XXIII, a hydrophilic and optionally positively charged head is

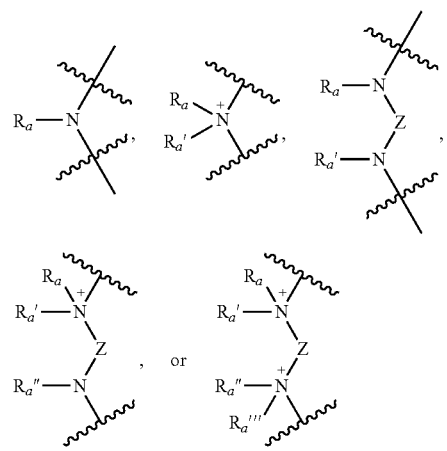

in which each of $R_a$, $R_a'$, $R_a''$, and $R_a'''$, independently, is H, a $C_1$-$C_{20}$ monovalent aliphatic radical, a $C_1$-$C_{20}$ monovalent heteroaliphatic radical, a monovalent aryl radical, or a monovalent heteroaryl radical, and Z is a $C_1$-$C_{20}$ bivalent aliphatic radical, a $C_1$-$C_{20}$ bivalent heteroaliphatic radical, a bivalent aryl radical, or a bivalent heteroaryl radical; B is a $C_1$-$C_{24}$ monovalent aliphatic radical, a $C_1$-$C_{24}$ monovalent heteroaliphatic radical, a monovalent aryl radical, a monovalent heteroaryl radical, or

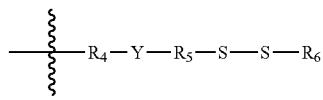

leach of $R_1$ and $R_4$, independently, is a bond, a $C_1$-$C_{10}$ bivalent aliphatic radical, a $C_1$-$C_{10}$ bivalent heteroaliphatic radical, a bivalent aryl radical, or a bivalent heteroaryl radical; each of $R_2$ and $R_5$, independently, is a bond, a $C_1$-$C_{20}$ bivalent aliphatic radical, a $C_1$-$C_{20}$ bivalent heteroaliphatic radical, a bivalent aryl radical, or a bivalent heteroaryl radical; each of $R_3$ and $R_6$, independently, is a $C_1$-$C_{20}$ monovalent aliphatic radical, a $C_1$-$C_{20}$ monovalent heteroaliphatic radical, a monovalent aryl radical, or a monovalent heteroaryl radical; each of

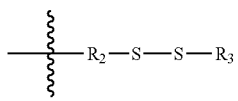

a hydrophobic tail, and

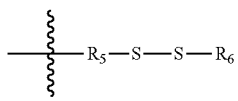

also a hydrophobic tail, has 8 to 24 carbon atoms; and each of X, a linker, and Y, also a linker, independently, is

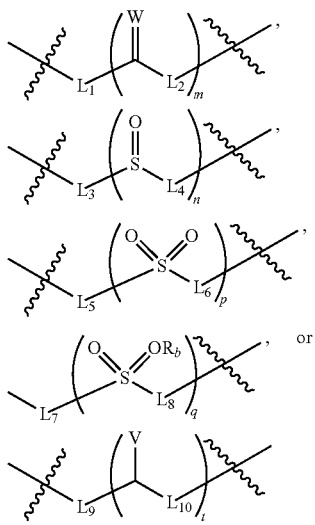

in which each of m, n, p, q, and t, independently, is 1-6; W is O, S, or $NR_c$; each of $L_1$, $L_3$, $L_5$, $L_7$, and $L_9$, directly linked to $R_1$, $R_2$, $R_4$, or $R_5$, independently, is a bond, O, S, or $NR_d$; each of $L^2$, $L^4$, $L_6$, $L_8$, and $L_{10}$, independently, is a bond, O, S, or $NR_e$; V is $OR_f$, $SR_g$, or $NR_hR_i$; and each of $R_b$, $R_c$, $R_d$, $R_e$, $R_f$, $R_g$, $R_h$, and $R_i$, independently, is H, OH, $C_{1-10}$ oxyaliphatic radical, $C_1$-$C_{10}$ monovalent aliphatic radical, $C_1$-$C_{10}$ monovalent heteroaliphatic radical, a monovalent aryl radical, or a monovalent heteroaryl radical.

A subset of the above-described lipid-like compounds include those in which A is

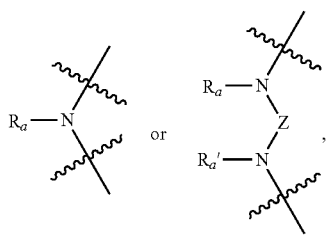

each of $R_a$ and $R_a'$, independently, being a $C_1$-$C_{10}$ monovalent monovalent aliphatic radical, a $C_1$-$C_{10}$ monovalent heteroaliphatic radical, a monovalent aryl radical, or a monovalent heteroaryl radical; and Z being a $C_1$-$C_{10}$ bivalent aliphatic radical, a $C_1$-$C_{10}$ bivalent heteroaliphatic radical, a bivalent aryl radical, or a bivalent heteroaryl radical.

Some lipid-like compounds of this invention feature each of $R_1$ and $R_4$, independently, being $C_1$-$C_6$ (e.g., $C_1$-$C_4$) bivalent aliphatic radical or a $C_1$-$C_6$ (e.g., $C_1$-$C_4$) bivalent heteroaliphatic radical, the total carbon number for $R_2$ and $R_3$ being 12-20 (e.g., 14-18), the total carbon number of $R_5$ and $R_6$ also being 12-20 (e.g., 14-18), and each of X and Y, independently, is

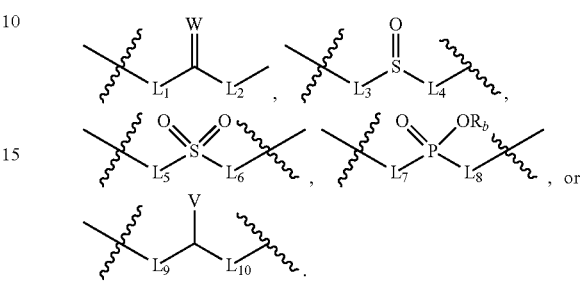

Specific examples of X and Y include

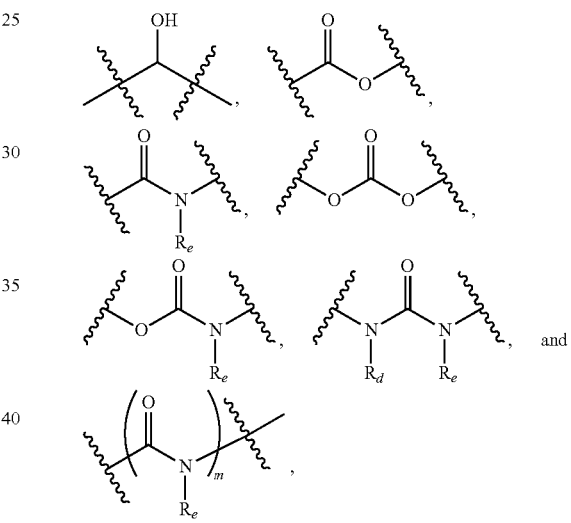

m being 2-6.

Still within the scope of this invention is a pharmaceutical composition containing a nanocomplex that is formed of a protein and a bioreducible compound. In this pharmaceutical composition, the nanocomplex has a particle size of 50 to 500 nm; the bioreducible compound contains a disulfide hydrophobic moiety, a hydrophilic moiety, and a linker joining the disulfide hydrophobic moiety and the hydrophilic moiety; and the protein binds to the bioreducible compound via a non-covalent interaction, a covalent bond, or both.

In certain embodiments, the disulfide hydrophobic moiety is a heteroaliphatic radical containing one or more —S—S— groups and 8 to 24 carbon atoms; the hydrophilic moiety is an aliphatic or heteroaliphatic radical containing one or more hydrophilic groups and 1-20 carbon atoms, each of the hydrophilic groups being amino, alkylamino, dialkylamino, trialkylamino, tetraalkylammonium, hydroxyamino, hydroxyl, carboxyl, carboxylate, carbamate, carbamide, carbonate, phosphate, phosphite, sulfate, sulfite, or thiosulfate; and the linker is O, S, Si, $C_1$-$C_6$ alkylene,

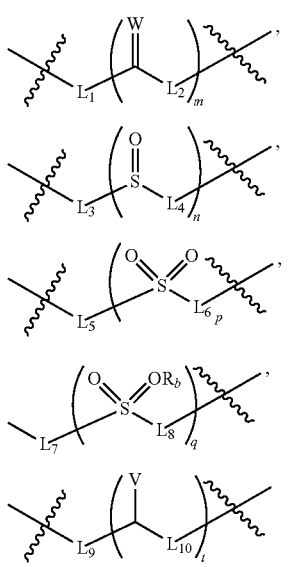

in which the variables are defined above.

Specific examples of X and Y include O, S, Si, $C_1$-$C_6$ alkylene,

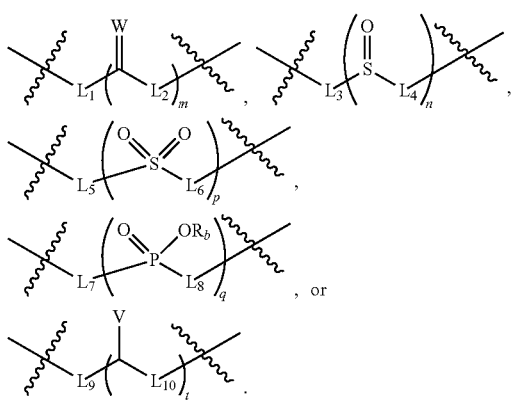

In some embodiments, a lipid-like compound of this invention, as shown instructure XXIII above, includes (i) a hydrophilic head, A; (ii) a hydrophobic tail, $R_2$—S—S—$R_3$; and (iii) a linker, X. Optionally, these compounds contain a second hydrophobic tail, $R_5$—S—S—$R_6$ and a second linker, Y.

The hydrophilic head of structure XXIII contains one or more hydrophilic functional groups, e.g., hydroxyl, carbonyl, carboxyl, amino, sulfhydryl, phosphate, amide, ester, ether, carbamate, carbonate, carbamide, and phosphodiester. These groups can form hydrogen bonds and are optionally positively or negatively charged.

Examples of the hydrophilic head include:

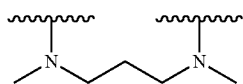

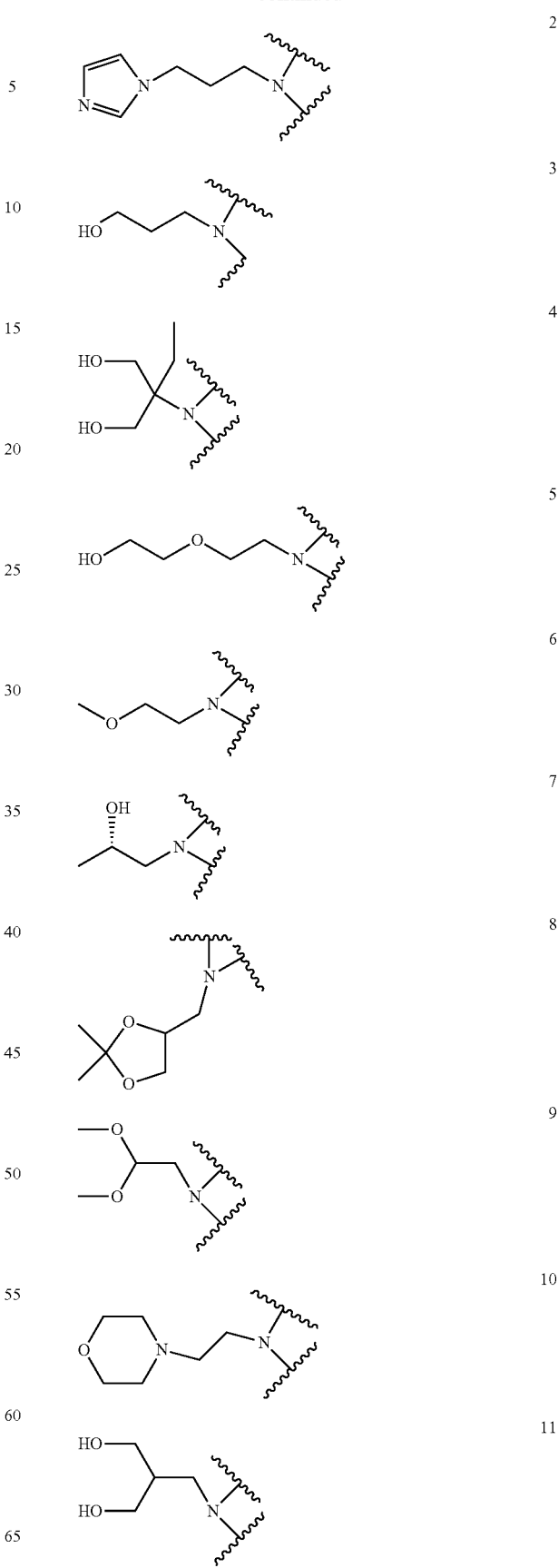

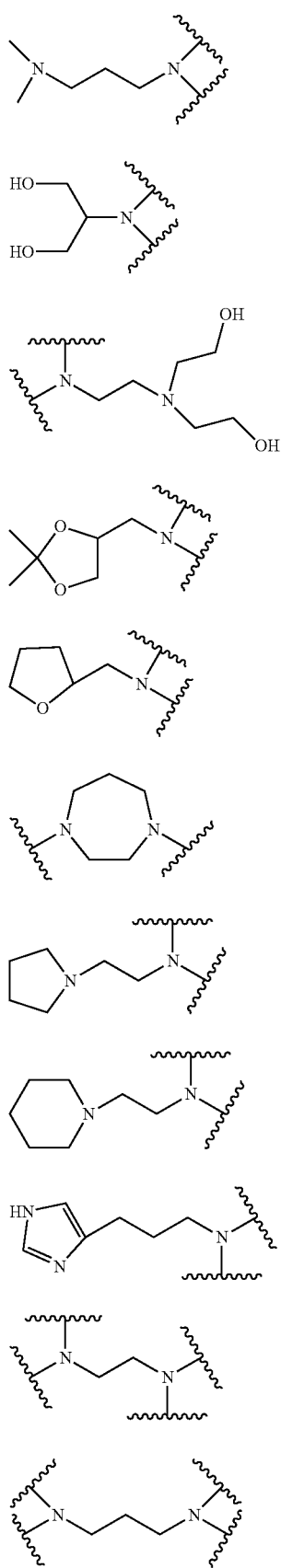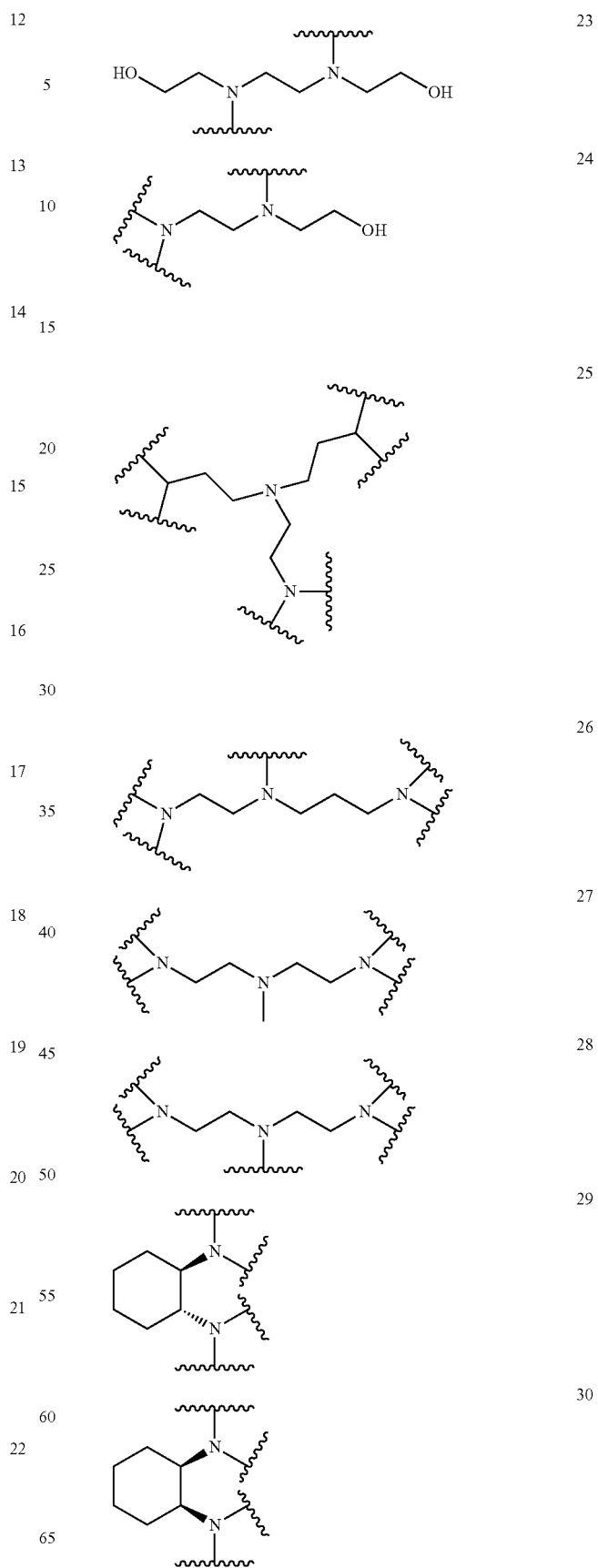

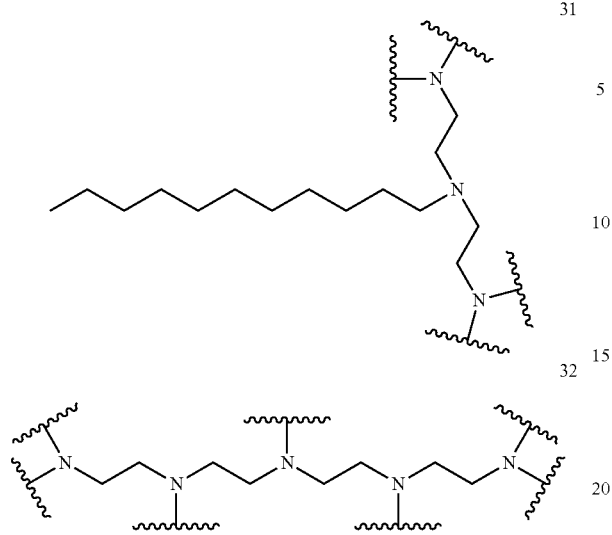

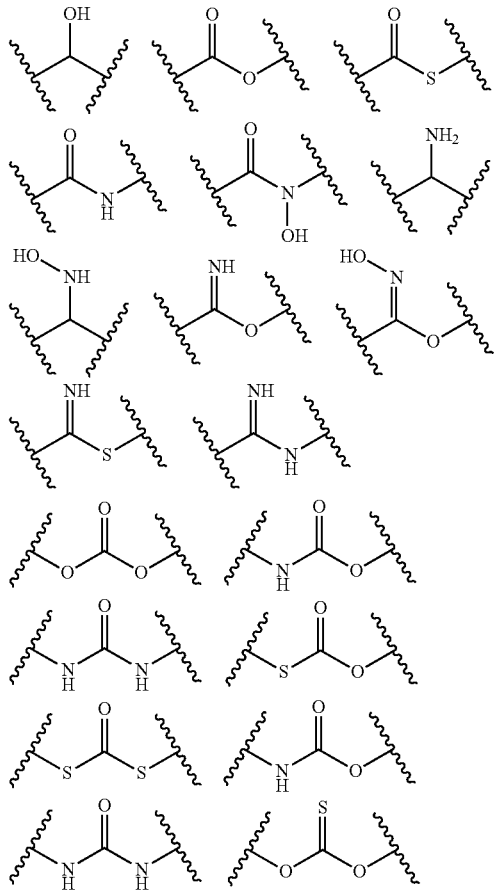

Other examples include those described in Akinc et al., Nature Biotechnology, 26, 561-69 (2008) and Mahon et al., US Patent Application Publication 2011/0293703.

The hydrophobic tail of structure XXIII is a saturated or unsaturated, linear or branched, acyclic or cyclic, aromatic or nonaromatic hydrocarbon moiety containing a disulfide bond and 8-24 carbon atoms. One or more of the carbon atoms can be replaced with a heteroatom, such as N, O, P, B, S, Si, Sb, Al, Sn, As, Se, and Ge. The tail is optionally substituted with one or more groups described above. The lipid-like compounds containing this disulfide bond can be bioreducible.

Examples include:

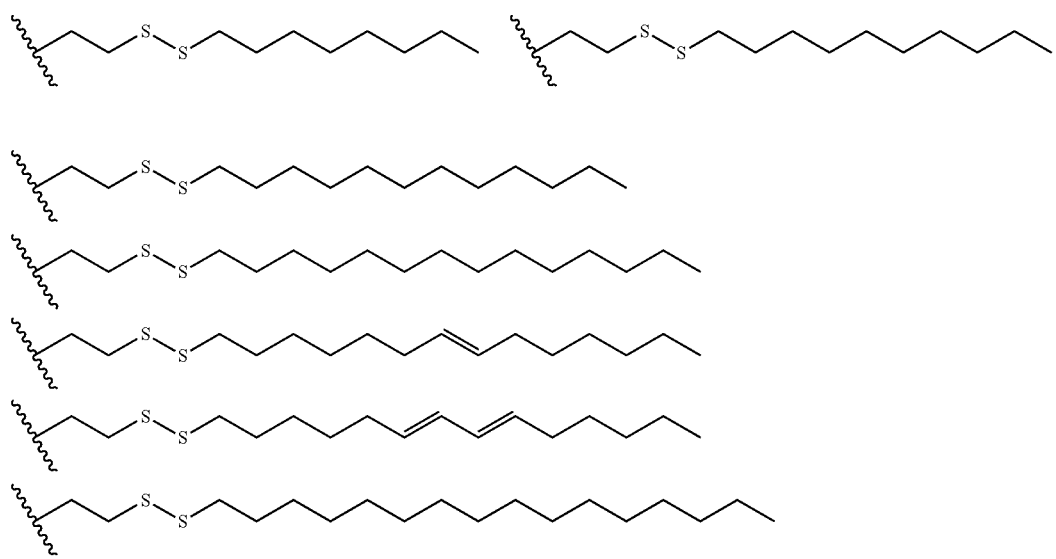

A linker of structure XXIII links the hydrophilic head and the hydrophobic tail. The linker can be any chemical group that is hydrophilic or hydrophobic, polar or non-polar, e.g., O, S, Si, amino, alkylene, ester, amide, carbamate, carbamide, carbonate, phosphate, phosphite, sulfate, sulfite, and thiosulfate. Examples include:

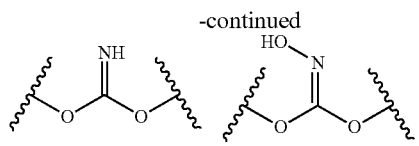

721
-continued
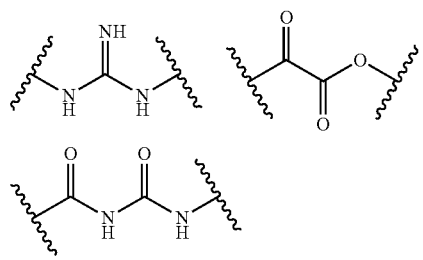
Shown below are exemplary lipid-like compounds of this invention:
80-O14B
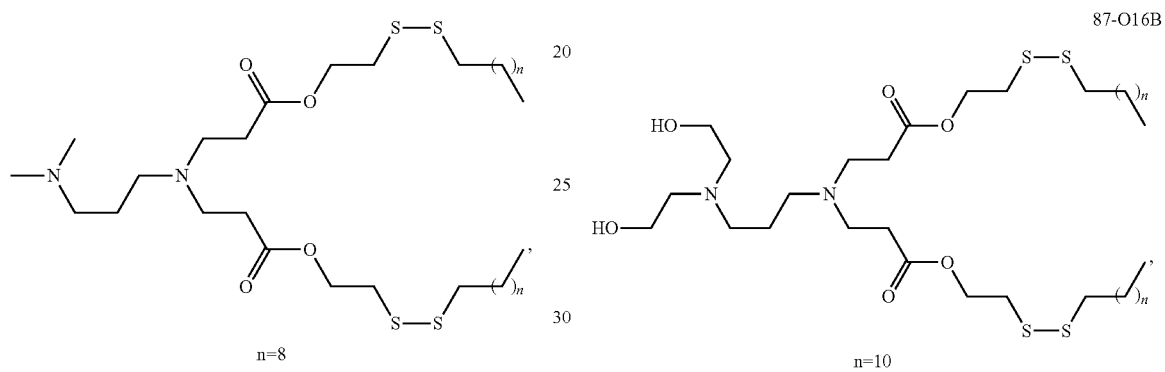
n=8
80-O16B
n=10
80-O18B
n=12
722
-continued
87-O14B
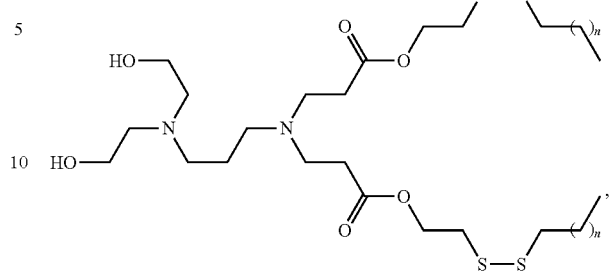
n=8
87-O16B
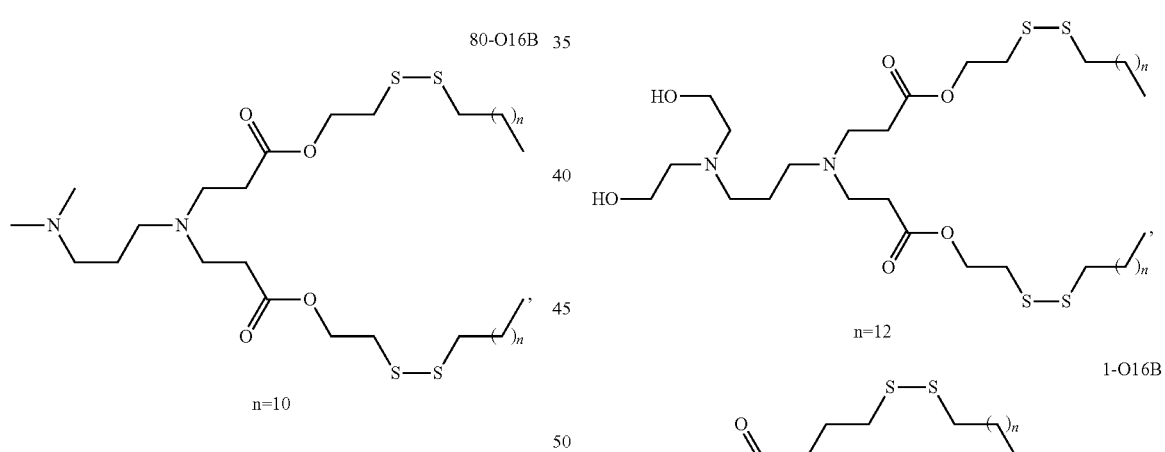
n=10
87-O18B
n=12
1-O16B
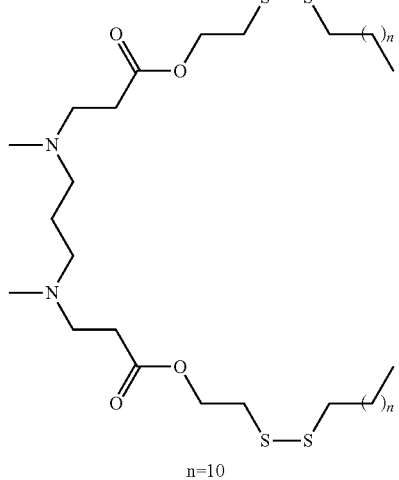
n=10

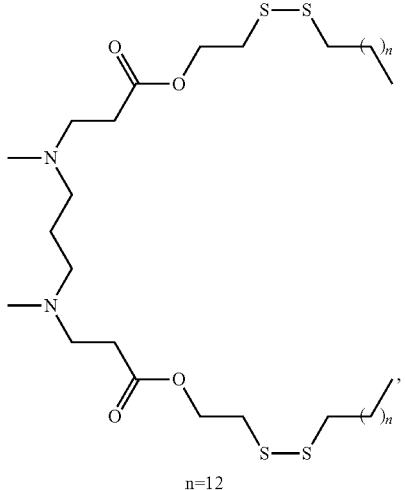

n=12

The lipid-like compounds of structure XXIII can be prepared by methods well known the art. See Wang et al., ACS Synthetic Biology, 1, 403-07 (2012); Manoharan, et al., International Patent Application Publication WO 2008/042973; and Zugates et al., U.S. Pat. No. 8,071,082. The route shown below exemplifies synthesis of these lipid-like compounds:

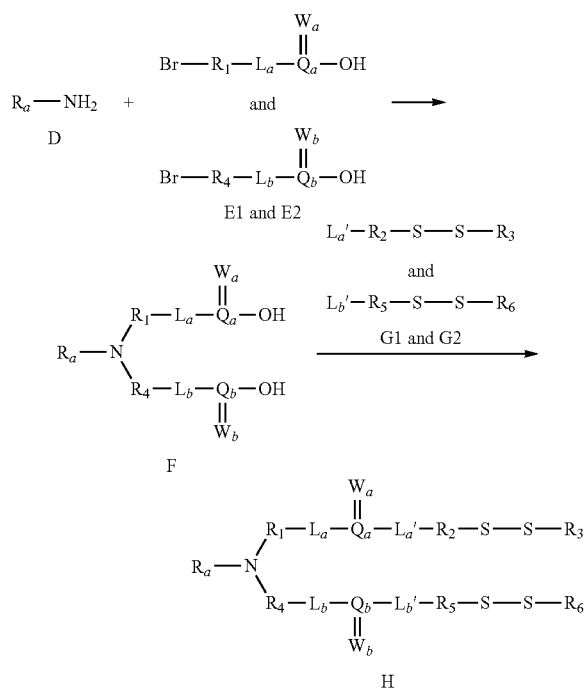

Each of $L_a$, $L_a'$, L, and L' can be one of $L_1$-$L_{10}$; each of $W_a$ and $W_b$, independently, is W or V; and $R_a$ and $R_1$-$R_6$ are defined above, as well as $L_1$-$L_{10}$, W, and V.

In this exemplary synthetic route, an amine compound, i.e., compound D, reacts with bromides E1 and E2 to form compound F, which is then coupled with both G1 and G2 to afford the final product, i.e., compound H. One or both of the double bonds in this compound (shown above) can be reduced to one or two single bonds to obtain different lipid-like compounds of structure XXIII.

Other lipid-like compounds of this invention can be prepared using other suitable starting materials through the above-described synthetic route and others known in the art. The method set forth above can include an additional step(s) to add or remove suitable protecting groups in order to ultimately allow synthesis of the lipid-like compounds. In addition, various synthetic steps can be performed in an alternate sequence or order to give the desired material. Synthetic chemistry transformations and protecting group methodologies (protection and deprotection) useful in synthesizing applicable lipid-like compounds are known in the art, including, for example, R. Larock, Comprehensive Organic Transformations (2nd Ed., VCH Publishers 1999); P. G. M. Wuts and T. W. Greene, Greene's Protective Groups in Organic Synthesis (4th Ed., John Wiley and Sons 2007); L. Fieser and M. Fieser, Fieser and Fieser's Reagents for Organic Synthesis (John Wiley and Sons 1994); and L. Paquette, ed., Encyclopedia of Reagents for Organic Synthesis (2nd ed., John Wiley and Sons 2009) and subsequent editions thereof. Certain lipid-like compounds may contain a non-aromatic double bond and one or more asymmetric centers. Thus, they can occur as racemates and racemic mixtures, single enantiomers, individual diastereomers, diastereomeric mixtures, and cis- or trans-isomeric forms. All such isomeric forms are contemplated.

As mentioned above, these lipid-like compounds are useful for delivery of pharmaceutical agents. They can be preliminarily screened for their efficacy in delivering pharmaceutical agents by an in vitro assay and then confirmed by animal experiments and clinic trials. Other methods will also be apparent to those of ordinary skill in the art.

Not to be bound by any theory, the lipid-like compounds of structure XXIII facilitate delivery of pharmaceutical agents by forming complexes, e.g., nanocomplexes and microparticles. The hydrophilic head of such a lipid-like compound, positively or negatively charged, binds to a moiety of a pharmaceutical agent that is oppositely charged and its hydrophobic moiety binds to a hydrophobic moiety of the pharmaceutical agent. Either binding can be covalent or non-covalent.

The above described complexes can be prepared using procedures described in publications such as Wang et al., ACS Synthetic Biology, 1, 403-07 (2012). Generally, they are obtained by incubating a lipid-like compound and a pharmaceutical agent in a buffer such as a sodium acetate buffer or a phosphate buffered saline ("PBS").

5.4 Hydrophilic Groups

In certain embodiments, the selected hydrophilic functional group or moiety may alter or otherwise impart properties to the compound or to the transfer vehicle of which such compound is a component (e.g., by improving the transfection efficiencies of a lipid nanoparticle of which the compound is a component). For example, the incorporation of guanidinium as a hydrophilic head-group in the compounds disclosed herein may promote the fusogenicity of such compounds (or of the transfer vehicle of which such compounds are a component) with the cell membrane of one or more target cells, thereby enhancing, for example, the transfection efficiencies of such compounds. It has been hypothesized that the nitrogen from the hydrophilic guanidinium moiety forms a six-membered ring transition state which grants stability to the interaction and thus allows for cellular uptake of encapsulated materials. (Wender, et al., Adv. Drug Del. Rev. (2008) 60: 452-472.) Similarly, the incorporation of one or more amino groups or moieties into the disclosed compounds (e.g., as a head-group) may further promote disruption of the endosomal/lysosomal membrane of the target cell by exploiting the fusogenicity of such amino groups. This is based not only on the pKa of the amino group of the composition, but also on the ability of the amino group to undergo a hexagonal phase transition and fuse with the target cell surface, i.e. the vesicle membrane. (Koltover, et al. Science (1998) 281: 78-81.) The result is believed to promote the disruption of the vesicle membrane and release of the lipid nanoparticle contents into the target cell.

Similarly, in certain embodiments the incorporation of, for example, imidazole as a hydrophilic head-group in the compounds disclosed herein may serve to promote endosomal or lysosomal release of, for example, contents that are encapsulated in a transfer vehicle (e.g., lipid nanoparticle) of the invention. Such enhanced release may be achieved by one or both of a proton-sponge mediated disruption mechanism and/or an enhanced fusogenicity mechanism. The proton-sponge mechanism is based on the ability of a compound, and in particular a functional moiety or group of the compound, to buffer the acidification of the endosome. This may be manipulated or otherwise controlled by the pKa of the compound or of one or more of the functional groups comprising such compound (e.g., imidazole). Accordingly, in certain embodiments the fusogenicity of, for example, the imidazole-based compounds disclosed herein (e.g., HGT4001 and HGT4004) are related to the endosomal disruption properties, which are facilitated by such imidazole groups, which have a lower pKa relative to other traditional ionizable lipids. Such endosomal disruption properties in turn promote osmotic swelling and the disruption of the liposomal membrane, followed by the transfection or intracellular release of the polynucleotide materials loaded or encapsulated therein into the target cell. This phenomenon can be applicable to a variety of compounds with desirable pKa profiles in addition to an imidazole moiety. Such embodiments also include multi-nitrogen based functionalities such as polyamines, poly-peptide (histidine), and nitrogen-based dendritic structures.

Exemplary ionizable and/or cationic lipids are described in International PCT patent publications WO2015/095340, WO2015/199952, WO2018/011633, WO2017/049245, WO2015/061467, WO2012/040184, WO2012/000104, WO2015/074085, WO2016/081029, WO2017/004 143, WO2017/075531, WO2017/117528, WO2011/022460, WO2013/148541, WO2013/116126, WO2011/153120, WO2012/044638, WO2012/054365, WO2011/090965, WO2013/016058, WO2012/162210, WO2008/042973, WO2010/129709, WO2010/144740, WO2012/099755, WO2013/049328, WO2013/086322, WO2013/086373, WO2011/071860, WO2009/132131, WO2010/048536, WO2010/088537, WO2010/054401, WO2010/054406 WO2010/054405, WO2010/054384, WO2012/016184, WO2009/086558, WO2010/042877, WO2011/000106, WO2011/000107, WO2005/120152, WO2011/141705, WO2013/126803, WO2006/007712, WO2011/038160, WO2005/121348, WO2011/066651, WO2009/127060, WO2011/141704, WO2006/069782, WO2012/031043, WO2013/006825, WO2013/033563, WO2013/089151, WO2017/099823, WO2015/095346, and WO2013/086354, and US patent publications US2016/0311759, US2015/0376115, US2016/0151284, US2017/0210697, US2015/0140070, US2013/0178541, US2013/0303587, US2015/0141678, US2015/0239926, US2016/0376224, US2017/0119904, US2012/0149894, US2015/0057373, US2013/0090372, US2013/0274523, US2013/0274504, US2013/0274504, US2009/0023673, US2012/0128760, US2010/0324120, US2014/0200257, US2015/0203446, US2018/0005363, US2014/0308304, US2013/0338210, US2012/0101148, US2012/0027796, US2012/0058144, US2013/0323269, US2011/0117125, US2011/0256175, US2012/0202871, US2011/0076335, US2006/0083780, US2013/0123338, US2015/0064242, US2006/0051405, US2013/0065939, US2006/0008910, US2003/0022649, US2010/0130588, US2013/0116307, US2010/0062967, US2013/0202684, US2014/0141070, US2014/0255472, US2014/0039032, US2018/0028664, US2016/0317458, and US2013/0195920, the contents of all of which are incorporated herein by reference in their entirety. International patent application WO 2019/131770 is also incorporated herein by reference in its entirety.

B. Stabilizing Lipids

A stabilizing lipid or surface stabilizing lipid may be used to enhance the structure of the LNP. A stabilizing lipid as contemplated herein may be a polyethylene glycol (PEG)-modified phospholipid. The use and inclusion of polyethylene glycol (PEG)-modified phospholipids and derivatized lipids such as derivatized ceramides (PEG-CER), including N-Octanoyl-Sphingosine-1-[Succinyl(Methoxy Polyethylene Glycol)-2000] (C8 PEG-2000 ceramide) in the liposomal and pharmaceutical compositions described herein is contemplated, preferably in combination with one or more of the compounds and lipids disclosed herein. Contemplated PEG-modified lipids include, but are not limited to, a polyethylene glycol chain of up to 5 kDa in length covalently attached to a lipid with alkyl chain(s) of C6-C20 length. In some embodiments, the PEG-modified lipid employed in the compositions and methods of the invention is 1,2-dimyristoyl-sn-glycerol, methoxypolyethylene Glycol (2000 MW PEG) "DMG-PEG2000." The addition of PEG-modified lipids to the lipid delivery vehicle may prevent complex aggregation and may also provide a means for increasing circulation lifetime and increasing the delivery of the lipid-polynucleotide composition to the target tissues, (Klibanov et al. (1990) FEBS Letters, 268 (1): 235-237), or they may be selected to rapidly exchange out of the formulation in vivo (see U.S. Pat. No. 5,885,613). Particularly useful exchangeable lipids are PEG-ceramides having shorter acyl chains (e.g., C14 or C18). The PEG-modified phospholipid and derivatized lipids of the present invention may comprise a molar ratio from about 0% to about 20%, about 0.5% to about 20%, about 1% to about 15%, about 4% to about 10%, or about 2% of the total lipid present in a liposomal lipid nanoparticle.

In an embodiment, a PEG-modified lipid is described in International Pat. Appl. No. PCT/US2019/015913, which is incorporated herein by reference in their entirety. In an embodiment, a transfer vehicle comprises one or more PEG-modified lipids.

Non-limiting examples of PEG-modified lipids include PEG-modified phosphatidylethanolamines and phosphatidic acids, PEG-ceramide conjugates (e.g., PEG-CerC14 or PEG-CerC20), PEG-modified dialkylamines and PEG-modified 1,2-diacyloxypropan-3-amines. In some further enbodiments, a PEG-modified lipid may be, e.g., PEG-c-DOMG, PEG-DMG, PEG-DLPE, PEG-DMPE, PEG-DPPC, or a PEG-DSPE.

In some still further embodiments, the PEG-modified lipid includes, but is not limited to 1,2-dimyristoyl-sn-glycerol methoxypolyethylene glycol (PEG-DMG), 1,2-distearoyl-sn-glycero-3-phosphoethanolamine-N-[amino(polyethylene glycol)] (PEG-DSPE), PEG-disteryl glycerol (PEG-DSG), PEG-dipalmetoleyl, PEG-dioleyl, PEG-distearyl, PEG-diacylglycamide (PEG-DAG), PEG-dipalmitoyl phosphatidylethanolamine (PEG-DPPE), or PEG-1,2-dimyristyloxlpropyl-3-amine (PEG-c-DMA).

In various embodiments, a PEG-modified lipid may also be referred to as "PEGylated lipid" or "PEG-lipid."

In one embodiment, the PEG-lipid is selected from the group consisting of a PEG-modified phosphatidylethanolamine, a PEG-modified phosphatidic acid, a PEG-modified ceramide, a PEG-modified dialkylamine, a PEG-modified diacylglycerol, a PEG-modified dialkylglycerol, and mixtures thereof.

In some embodiments, the lipid moiety of the PEG-lipids includes those having lengths of from about $C_{14}$ to about $C_{22}$, such as from about $C_{14}$ to about $C_{16}$. In some embodiments, a PEG moiety, for example a mPEG-$NH_2$, has a size of about 1000, about 2000, about 5000, about 10,000, about 15,000 or about 20,000 daltons. In one embodiment, the PEG-lipid is PEG2k-DMG.

In one embodiment, the lipid nanoparticles described herein can comprise a lipid modified with a non-diffusible PEG. Non-limiting examples of non-diffusible PEGs include PEG-DSG and PEG-DSPE.

PEG-lipids are known in the art, such as those described in U.S. Pat. No. 8,158,601 and International Pat. Publ. No. WO2015/130584 A2, which are incorporated herein by reference in their entirety.

In various embodiments, lipids (e.g., PEG-lipids), described herein may be synthesized as described International Pat. Publ. No. PCT/US2016/000129, which is incorporated by reference in its entirety.

The lipid component of a lipid nanoparticle composition may include one or more molecules comprising polyethylene glycol, such as PEG or PEG-modified lipids. Such species may be alternately referred to as PEGylated lipids. A PEG lipid is a lipid modified with polyethylene glycol. A PEG lipid may be selected from the non-limiting group including PEG-modified phosphatidylethanolamines, PEG-modified phosphatidic acids, PEG-modified ceramides, PEG-modified dialkylamines, PEG-modified diacylglycerols, PEG-modified dialkylglycerols, and mixtures thereof. For example, a PEG lipid may be PEG-c-DOMG, PEG-DMG, PEG-DLPE, PEG-DMPE, PEG-DPPC, or a PEG-DSPE lipid.

In some embodiments the PEG-modified lipids are a modified form of PEG-DMG. PEG-DMG has the following structure:

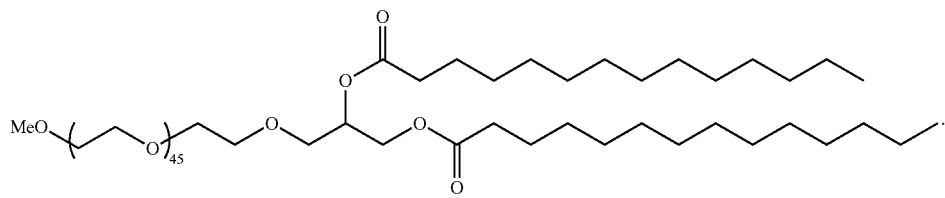

In some embodiments the PEG-modified lipids are a modified form of PEG-C18, or PEG-1. PEG-1 has the following structure

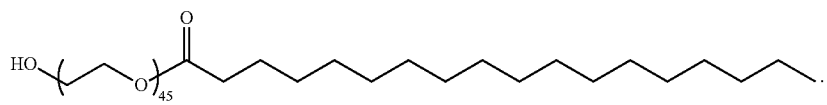

In one embodiment, PEG lipids useful in the present invention can be PEGylated lipids described in International Publication No. WO2012099755, the contents of which is herein incorporated by reference in its entirety. Any of these exemplary PEG lipids described herein may be modified to comprise a hydroxyl group on the PEG chain. In certain embodiments, the PEG lipid is a PEG-OH lipid. In certain embodiments, the PEG-OH lipid includes one or more hydroxyl groups on the PEG chain. In certain embodiments, a PEG-OH or hydroxy-PEGylated lipid comprises an —OH group at the terminus of the PEG chain. Each possibility represents a separate embodiment of the present invention.

In some embodiments, the PEG lipid is a compound of Formula (P1):

(P1)

or a salt or isomer thereof, wherein:
r is an integer between 1 and 100;
R is $C_{10-40}$ alkyl, $C_{10-40}$ alkenyl, or $C_{10-40}$ alkynyl; and optionally one or more methylene groups of R are independently replaced with $C_{3-10}$ carbocyclylene, 4 to 10 membered heterocyclylene, $C_{6-10}$ arylene, 4 to 10 membered heteroarylene, —N($R^N$)—, —O—, —S—, —C(O)—, —C(O)N($R^N$)—, —$NR^N$C(O)—, —$NR^N$C(O)N($R^N$)—, —C(O)O—, —OC(O)—, —OC(O)O—, —OC(O)N($R^N$)—, —$NR^N$C)—, —C(O)S—, —SC(O)—, —C(=$NR^N$)—, —C(=$NR^N$)N($R^N$)—, —$NR^N$C(=$NR^N$)—, —$NR^N$C(=$NR^N$)N($R^N$) C(S)—, —C(S)N($R^N$)—, —$NR^N$C(S)—, —$NR^N$C(S)N($R^N$)—, —S(O)—, —OS(O)—, —S(O)O—, —OS(O)O—, —OS(O)$_2$—, —S(O)$_{20}$—, —OS(O)$_{20}$—, —N($R^N$)S(O)—, —S(O)N($R^N$)—, —N($R^N$)S(O)N($R^N$)—, —OS(O)N($R^N$)—, —N($R^N$)S(O)O—, —S(O)$_2$—, —N($R^N$)S(O)$_2$—, —S(O)$_2$N($R^N$)—, —N($R^N$)S(O)$_2$N($R^N$)—, —OS(O)$_2$N($R^N$)—, or —N($R^N$)S(O)$_2$O—; and each instance of $R^N$ is independently hydrogen, $C_{1-6}$ alkyl, or a nitrogen protecting group.

For example, R is C17 alkyl. For example, the PEG lipid is a compound of Formula (P1-a):

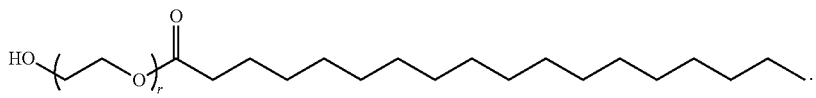

or a salt or isomer thereof, wherein r is an integer between 1 and 100.

For example, the PEG lipid is a compound of the following formula:

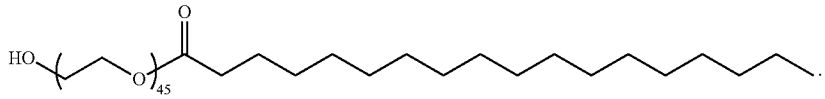

C. Helper Lipids

In some embodiments, the transfer vehicle (e.g., LNP) described herein comprises one or more non-cationic helper lipids. In some embodiments, the helper lipid is a phospholipid. In some embodiments, the helper lipid is a phospholipid substitute or replacement. In some embodiments, the phospholipid or phospholipid substitute can be, for example, one or more saturated or (poly)unsaturated phospholipids, or phospholipid substitutes, or a combination thereof. In general, phospholipids comprise a phospholipid moiety and one or more fatty acid moieties.

A phospholipid moiety can be selected, for example, from the non-limiting group consisting of phosphatidyl choline, phosphatidyl ethanolamine, phosphatidyl glycerol, phosphatidyl serine, phosphatidic acid, 2-lysophosphatidyl choline, and a sphingomyelin.

A fatty acid moiety can be selected, for example, from the non-limiting group consisting of lauric acid, myristic acid, myristoleic acid, palmitic acid, palmitoleic acid, stearic acid, oleic acid, linoleic acid, alpha-linolenic acid, erucic acid, phytanoic acid, arachidic acid, arachidonic acid, eicosapentaenoic acid, behenic acid, docosapentaenoic acid, and docosahexaenoic acid.

Phospholipids include, but are not limited to, glycerophospholipids such as phosphatidylcholines, phosphatidylethanolamines, phosphatidylserines, phosphatidylinositols, phosphatidy glycerols, and phosphatidic acids. Phospholipids also include phosphosphingolipid, such as sphingomyelin.

In some embodiments, the helper lipid is a 1,2-distearoyl-177-glycero-3-phosphocholine (DSPC) analog, a DSPC substitute, oleic acid, or an oleic acid analog.

In some embodiments, a helper lipid is a non-phosphatidyl choline (PC) zwitterionic lipid, a DSPC analog, oleic acid, an oleic acid analog, or a DSPC substitute.

In some embodiments, a helper lipid is described in PCT/US2018/053569. Helper lipids suitable for use in a lipid composition of the disclosure include, for example, a variety of neutral, uncharged or zwitterionic lipids. Such helper lipids are preferably used in combination with one or more of the compounds and lipids disclosed herein. Examples of helper lipids include, but are not limited to, 5-heptadecylbenzene-1,3-diol (resorcinol), dipalmitoylphosphatidylcholine (DPPC), distearoylphosphatidylcholine (DSPC), pohsphocholine (DOPC), dimyristoylphosphatidylcholine (DMPC), phosphatidylcholine (PLPC), 1,2-distearoylsn-glycero-3-phosphocholine (DAPC), phosphatidylethanolamine (PE), egg phosphatidylcholine (EPC), dilauryloylphosphatidylcholine (DLPC), dimyristoylphosphatidylcholine (DMPC), 1-myristoyl-2-palmitoyl phosphatidylcholine (MPPC), 1-paimitoyl-2-myristoyl phosphatidylcholine (PMPC), 1-palmitoyl-2-stearoyl phosphatidylcholine (PSPC), 1,2-diarachidoyl-sn-glycero-3-phosphocholine (DBPC), 1-stearoyl-2-palmitoyl phosphatidylcholine (SPPC), 1,2-dieicosenoyl-sn-glycero-3-phosphocholine (DEPC), paimitoyioieoyl phosphatidylcholine (POPC), lysophosphatidyl choline, dioleoyl phosphatidylethanol amine (DOPE) dilinoleoylphosphatidylcholine distearoylphosphatidylethanolamine (DSPE), dimyristoyl phosphatidylethanolamine (DMPE), dipalmitoyl phosphatidylethanolamine (DPPE), palmitoyloleoyl phosphatidylethanolamine (POPE), lysophosphatidylethanolamine and combinations thereof. In one embodiment, the helper lipid may be distearoylphosphatidylcholine (DSPC) or dimyristoyl phosphatidyl ethanolamine (DMPE). In another embodiment, the helper lipid may be distearoylphosphatidylcholine (DSPC). Helper lipids function to stabilize and improve processing of the transfer vehicles. Such helper lipids are preferably used in combination with other excipients, for example, one or more of the ionizable lipids disclosed herein. In some embodiments, when used in combination with an ionizable lipid, the helper lipid may comprise a molar ratio of 5% to about 90%, or about 10% to about 70% of the total lipid present in the lipid nanoparticle.

D. Structural Lipids

In an embodiment, a structural lipid is described in international patent application PCT/US2019/015913.

The transfer vehicles described herein comprise one or more structural lipids. Incorporation of structural lipids in the lipid nanoparticle may help mitigate aggregation of other lipids in the particle. Structural lipids can include, but are not limited to, cholesterol, fecosterol, ergosterol, bassicasterol, tomatidine, tomatine, ursolic, alpha-tocopherol, and mixtures thereof. In certain embodiments, the structural lipid is cholesterol. In certain embodiments, the structural lipid includes cholesterol and a corticosteroid (such as, for example, prednisolone, dexamethasone, prednisone, and hydrocortisone), or a combination thereof.

In some embodiments, the structural lipid is a sterol. In certain embodiments, the structural lipid is a steroid. In certain embodiments, the structural lipid is cholesterol. In certain embodiments, the structural lipid is an analog of cholesterol. In certain embodiments, the structural lipid is alpha-tocopherol.

The transfer vehicles described herein comprise one or more structural lipids. Incorporation of structural lipids in a transfer vehicle, e.g., a lipid nanoparticle, may help mitigate aggregation of other lipids in the particle. In certain embodiments, the structural lipid includes cholesterol and a corticosteroid (such as, for example, prednisolone, dexamethasone, prednisone, and hydrocortisone), or a combination thereof.

In some embodiments, the structural lipid is a sterol. Structural lipids can include, but are not limited to, sterols (e.g., phytosterols or zoosterols).

In certain embodiments, the structural lipid is a steroid. For example, sterols can include, but are not limited to, cholesterol, 0-sitosterol, fecosterol, ergosterol, sitosterol, campesterol, stigmasterol, brassicasterol, ergosterol, tomatidine, tomatine, ursolic acid, or alpha-tocopherol.

In some embodiments, a transfer vehicle includes an effective amount of an immune cell delivery potentiating lipid, e.g., a cholesterol analog or an amino lipid or combination thereof, that, when present in a transfer vehicle, e.g., an lipid nanoparticle, may function by enhancing cellular association and/or uptake, internalization, intracellular trafficking and/or processing, and/or endosomal escape and/or may enhance recognition by and/or binding to immune cells, relative to a transfer vehicle lacking the immune cell delivery potentiating lipid. Accordingly, while not intending to be bound by any particular mechanism or theory, in one embodiment, a structural lipid or other immune cell delivery potentiating lipid of the disclosure binds to C1q or promotes the binding of a transfer vehicle comprising such lipid to C1q. Thus, for in vitro use of the transfer vehicles of the disclosure for delivery of a nucleic acid molecule to an immune cell, culture conditions that include C1q are used (e.g., use of culture media that includes serum or addition of exogenous C1q to serum-free media). For in vivo use of the transfer vehicles of the disclosure, the requirement for C1q is supplied by endogenous C1q.

In certain embodiments, the structural lipid is cholesterol. In certain embodiments, the structural lipid is an analog of cholesterol. In some embodiments, the structural lipid is a lipid in Table 16:

| CMPD No. S- | Structure |
| --- | --- |
| 1 | 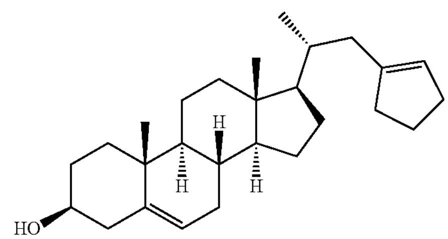 |
| 22 | 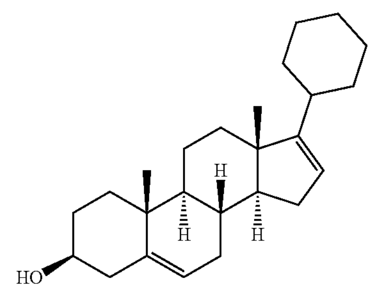 |
| 2 | 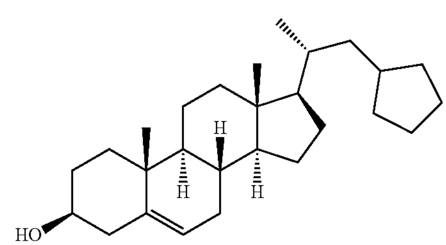 |
| 3 | 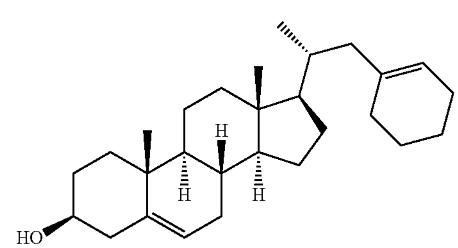 |

-continued
| | |
|---|---|
| 4 | 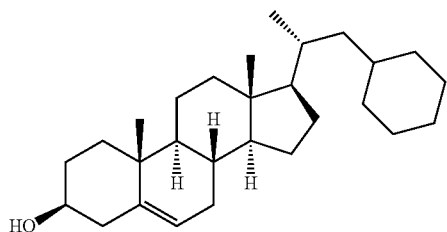 |
| 5 | 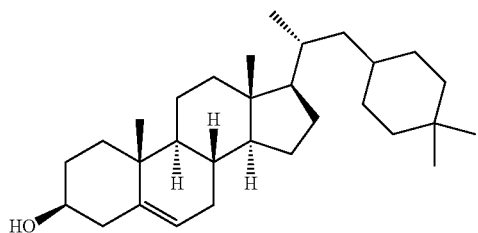 |
| 6 | 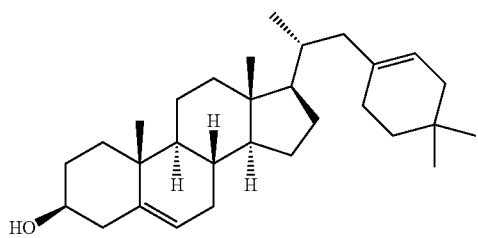 |
| 7 | 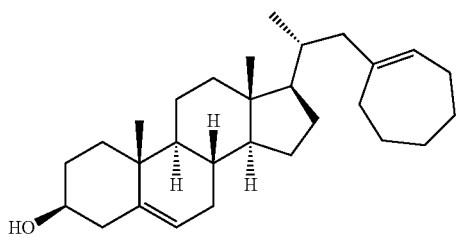 |
| 23 | 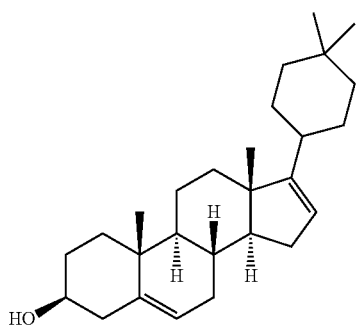 |
| 24 | 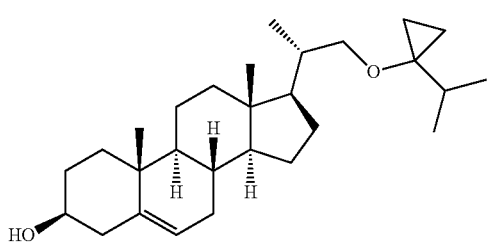 |

25
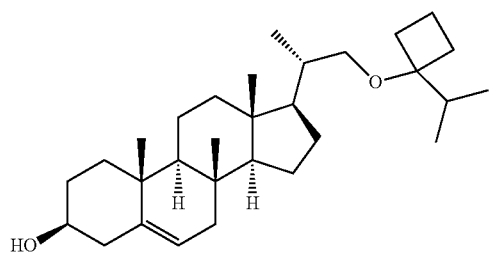
26
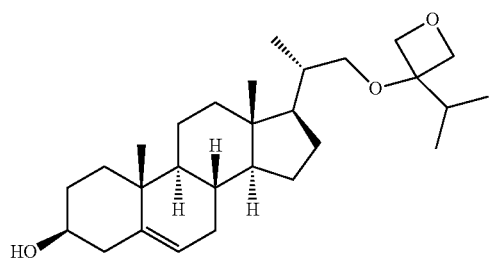
27
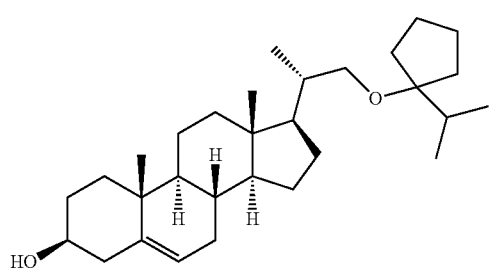
28
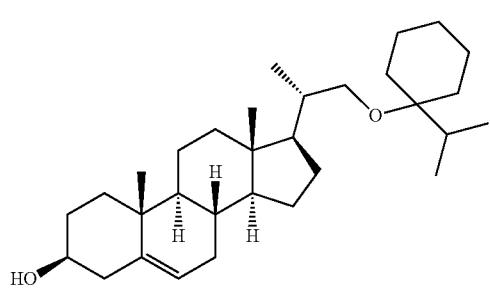
8
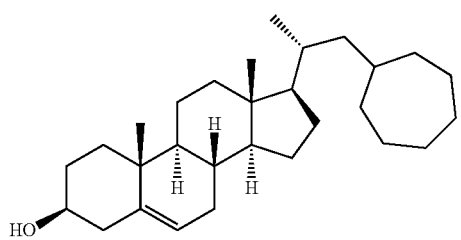
9
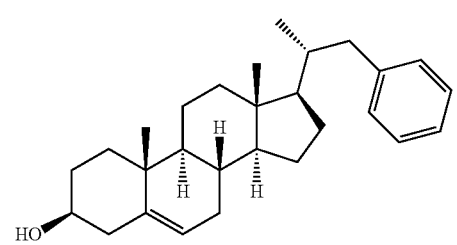

10
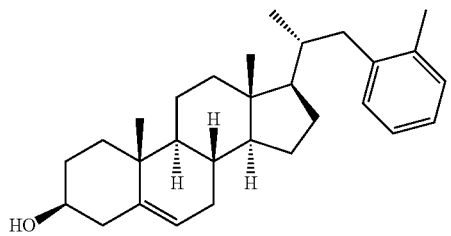
11
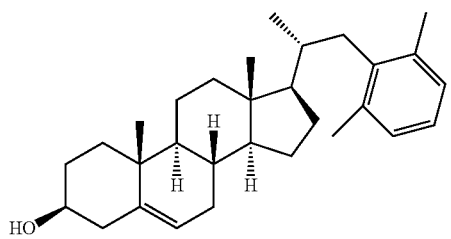
12
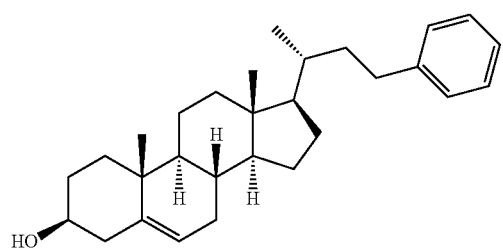
13
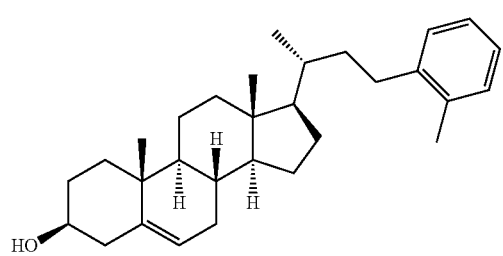
29
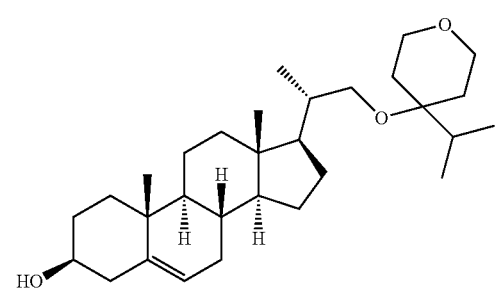
30
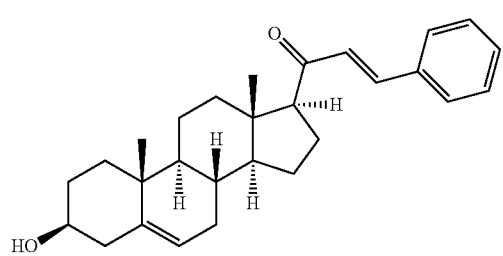

-continued
31
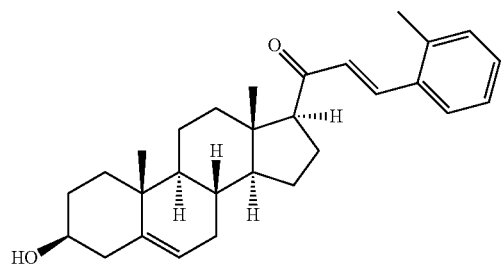
32
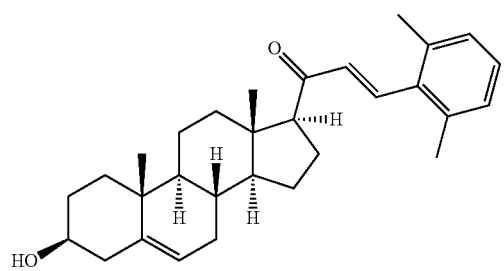
33
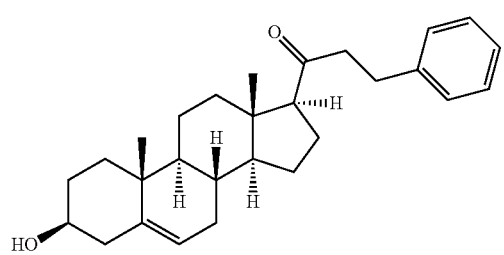
34
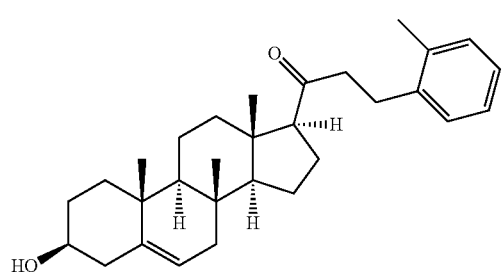
14
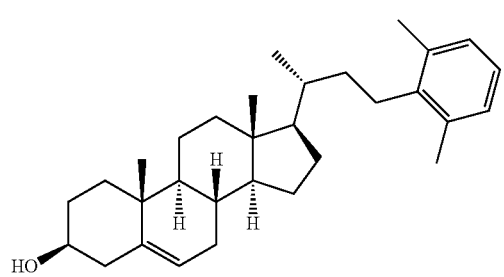
15
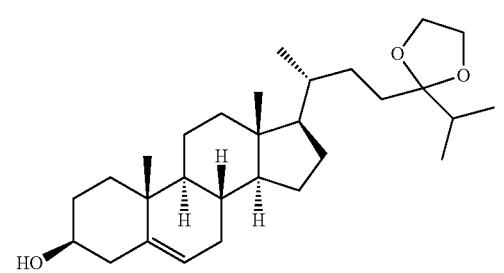

16
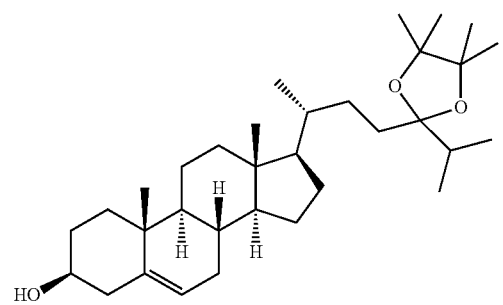
17
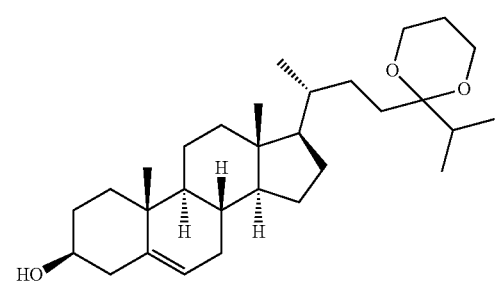
18
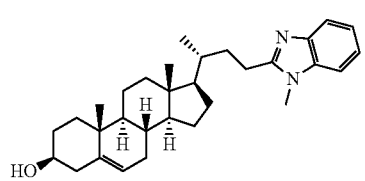
19
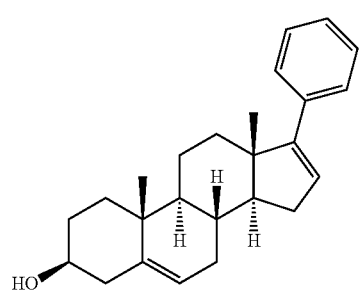
35
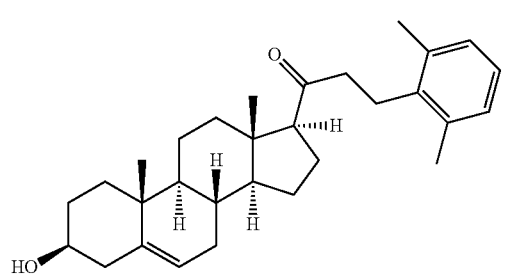
36
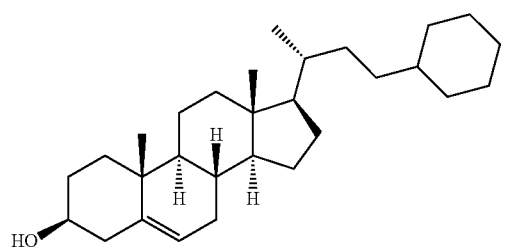

-continued
37
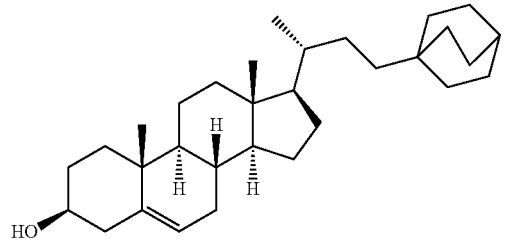
38
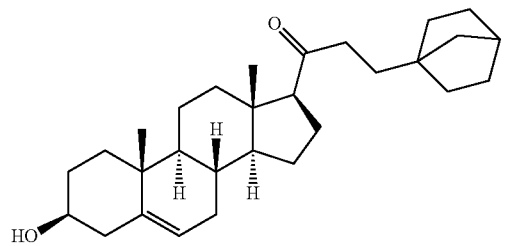
39
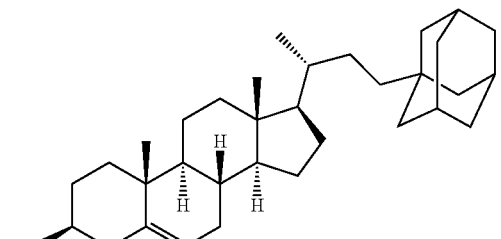
40
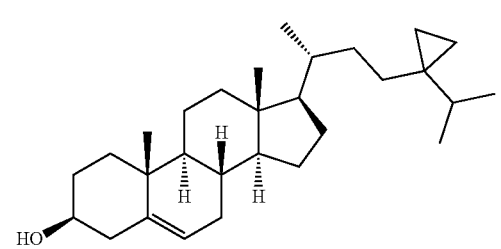
20
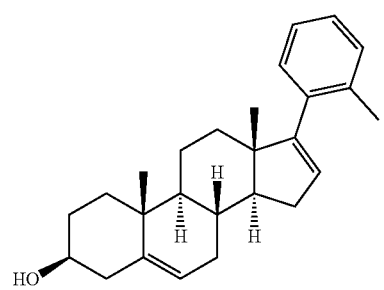
21
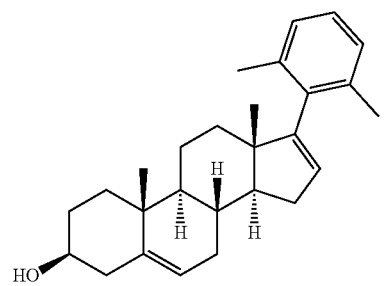

150 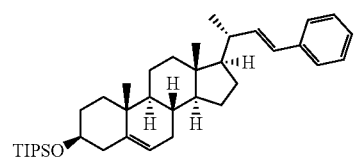
154 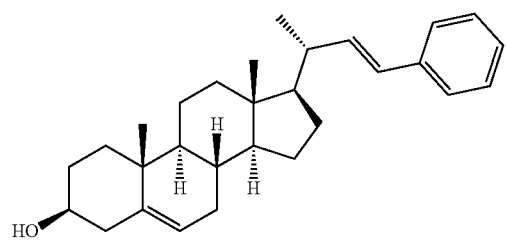
162 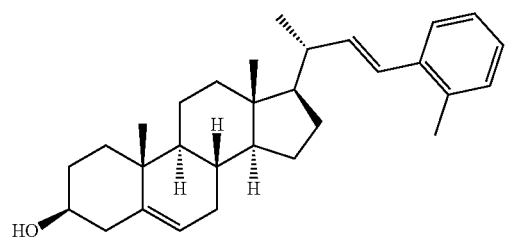
41 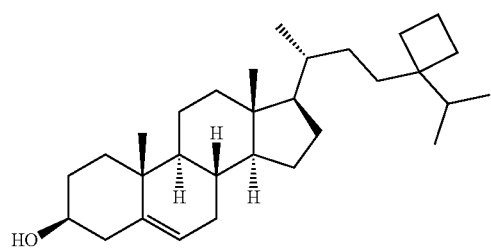
42 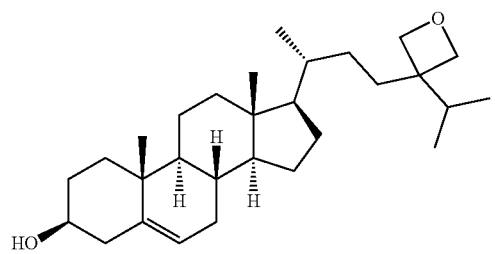
165 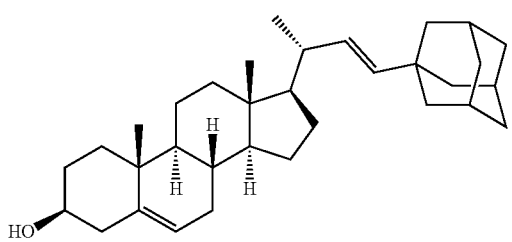

169 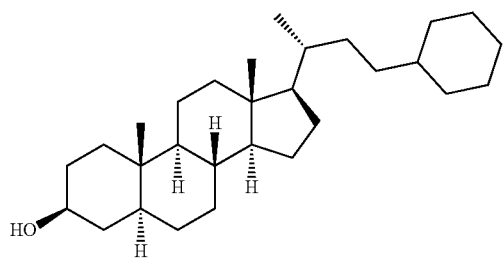
170 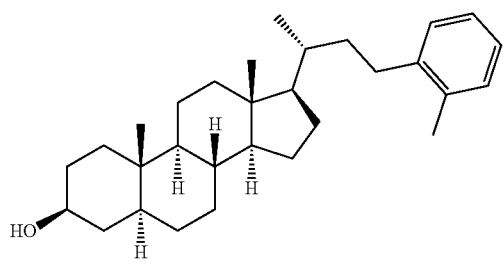
163 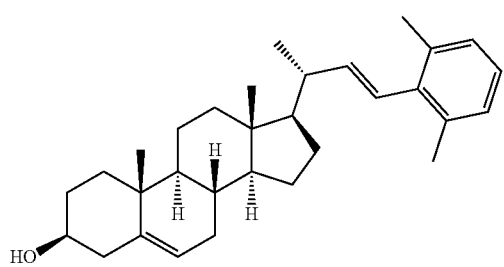
164 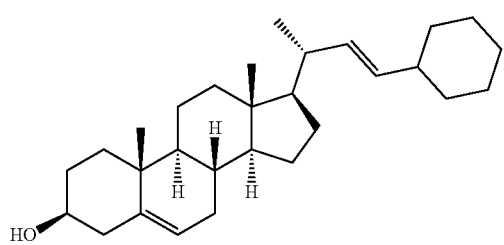
184 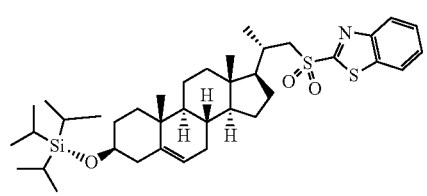
171 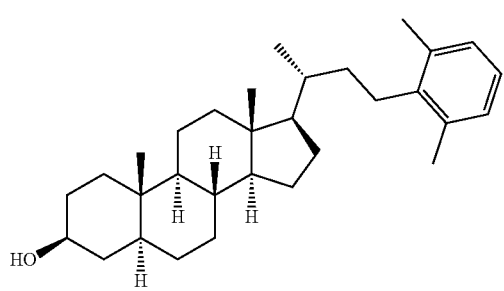

-continued
172
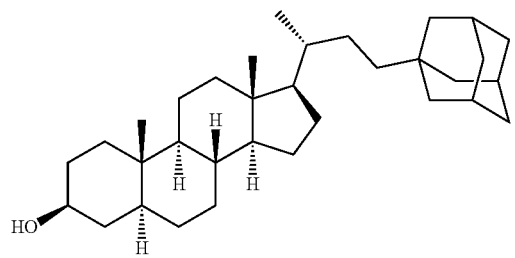
43
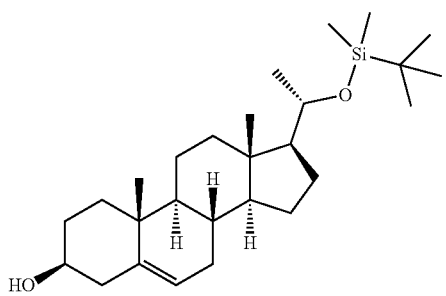
47
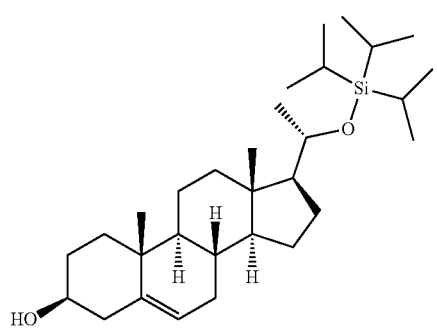
44
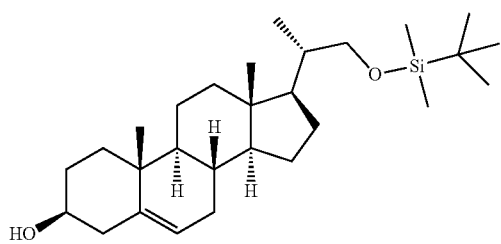
45
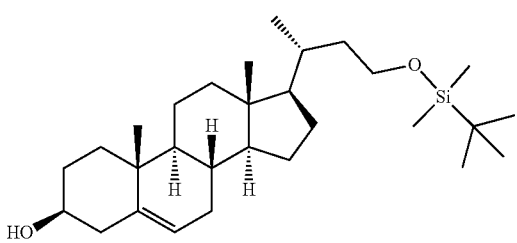
46
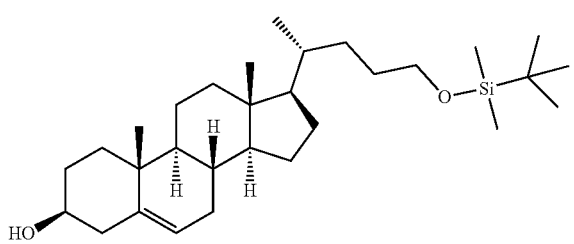

-continued
175
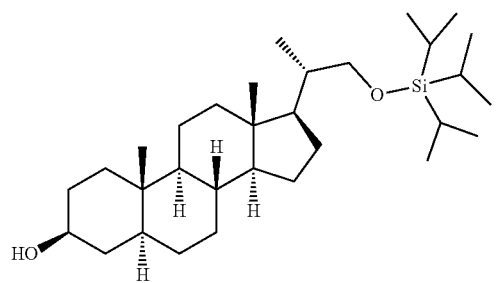
176
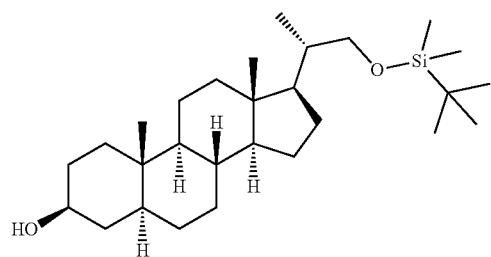
48
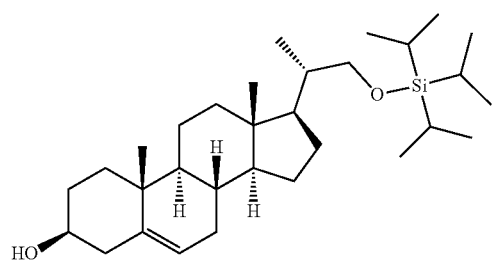
49
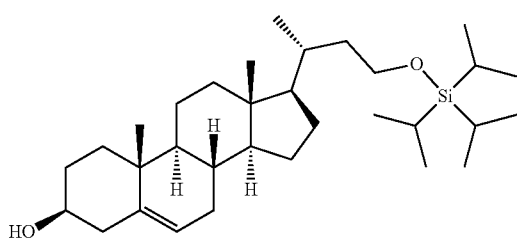
50
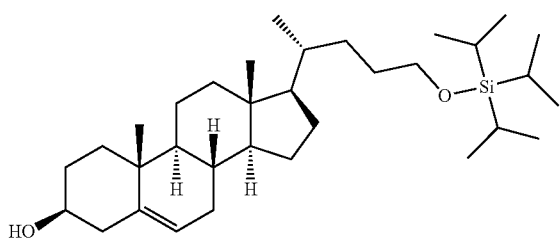
177
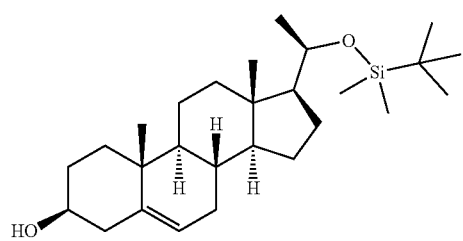

-continued
178
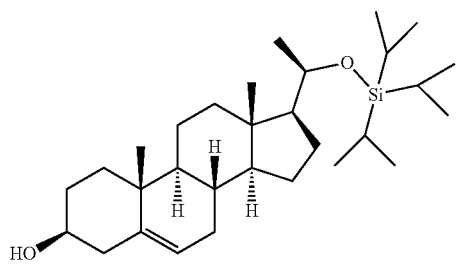
51
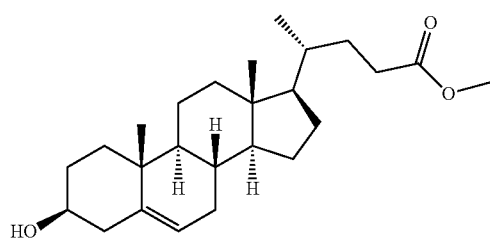
52
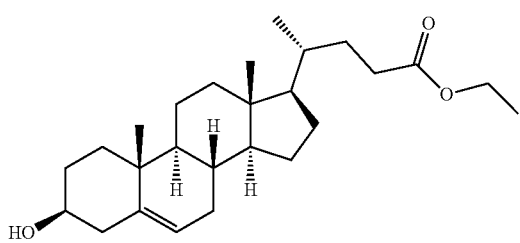
53
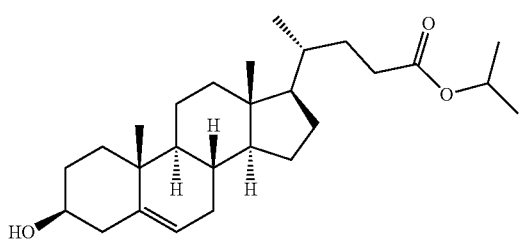
54
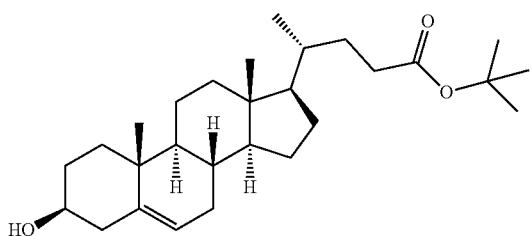
55
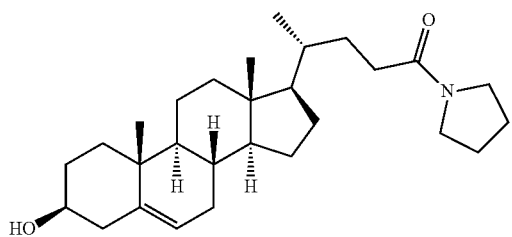

-continued
56
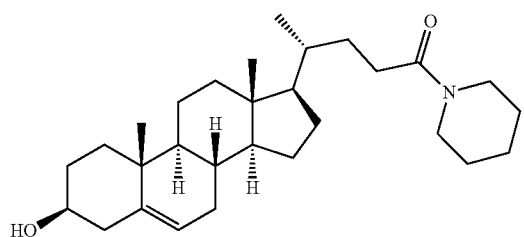
57
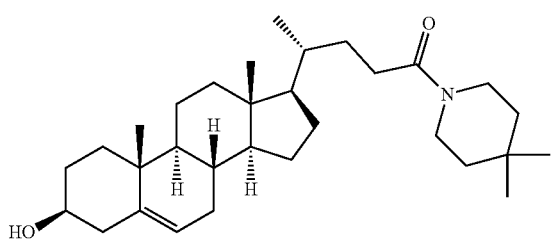
60
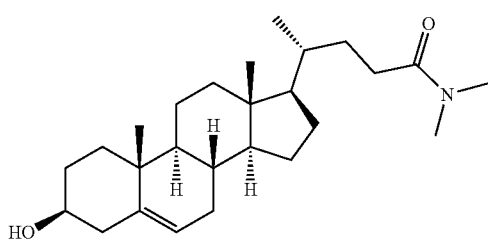
61
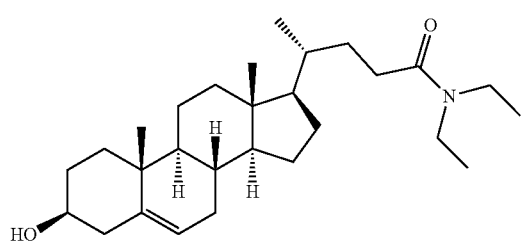
62
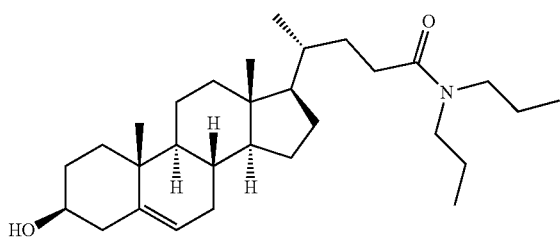
63
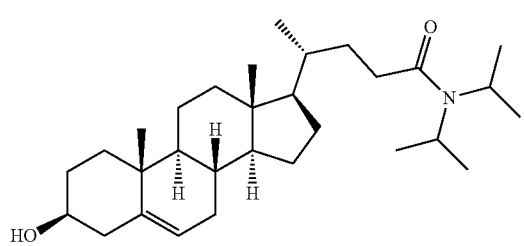

-continued
64
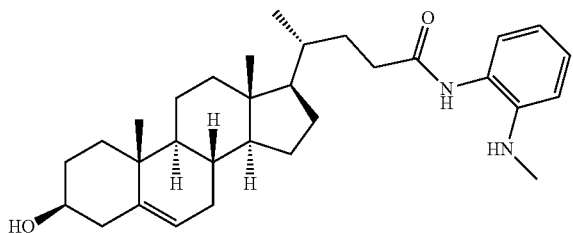
65
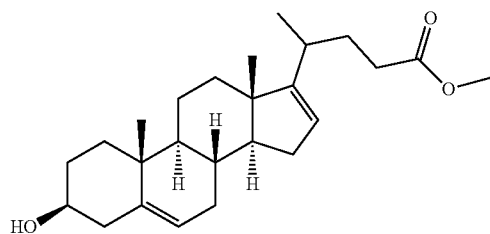
66
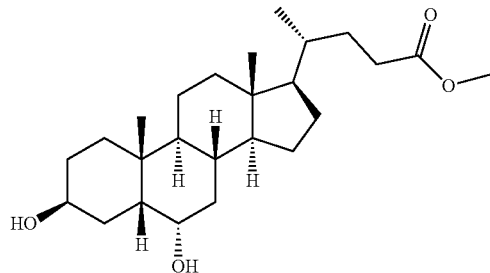
58
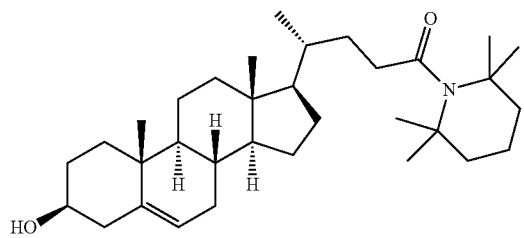
59
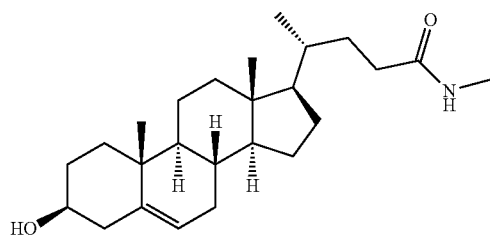
153
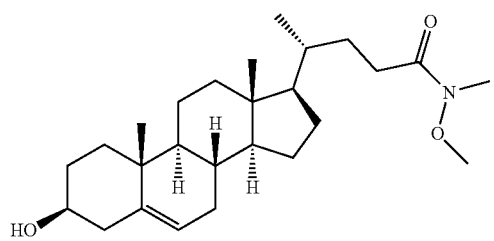

-continued
67
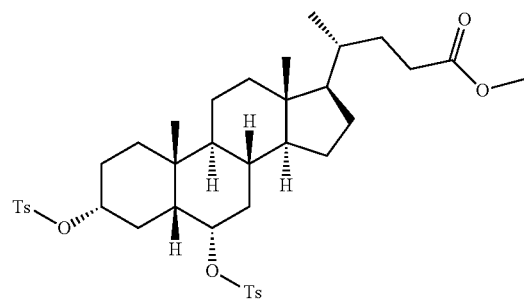
149
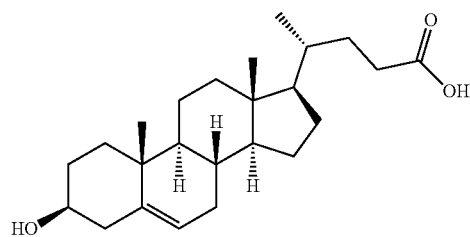
68
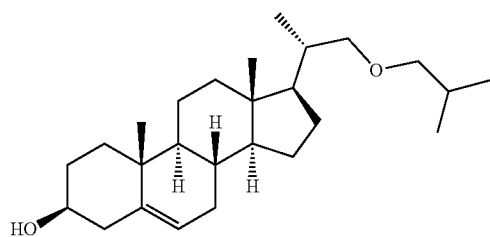
69
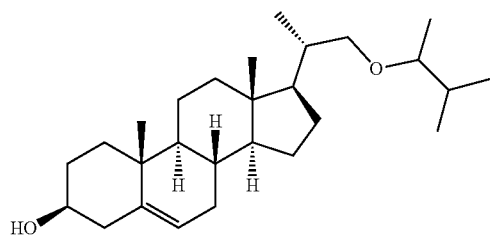
71
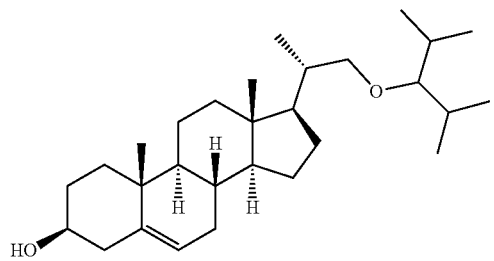
72
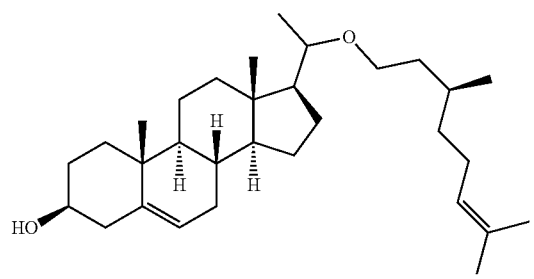

-continued
70
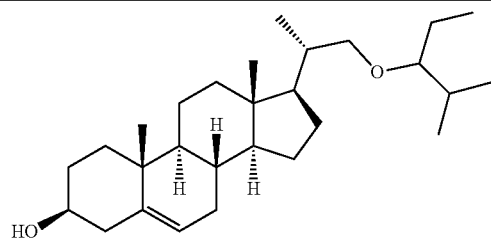
73
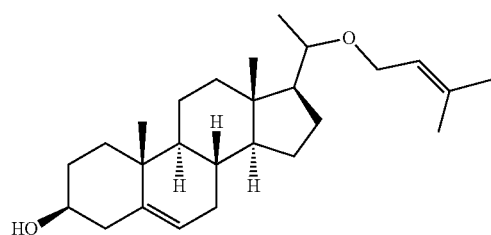
74
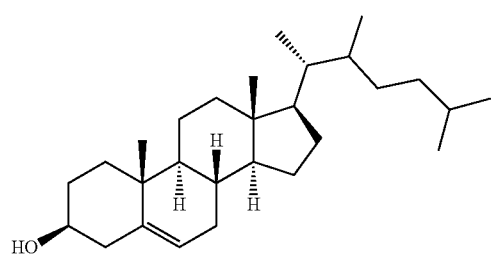
75
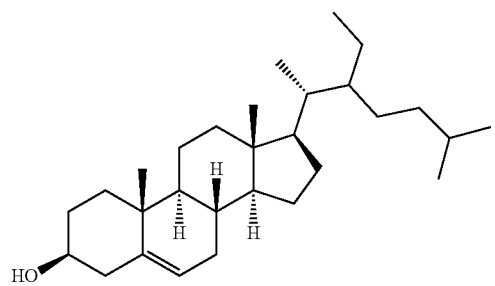
76
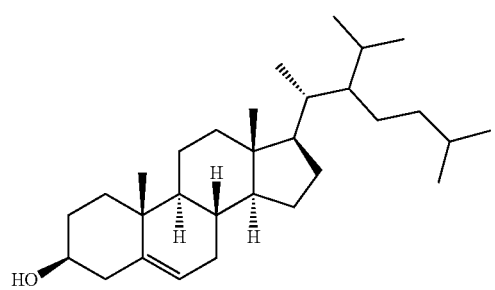
77
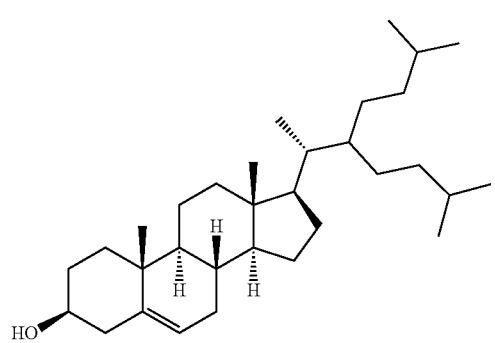

-continued
78
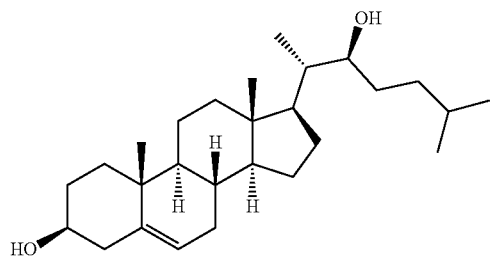
79
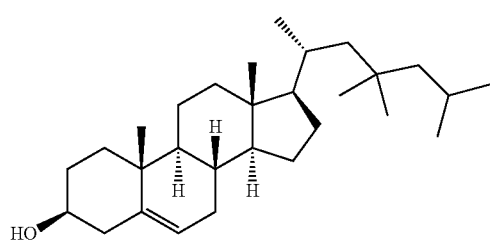
80
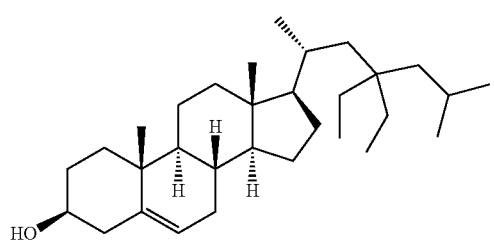
81
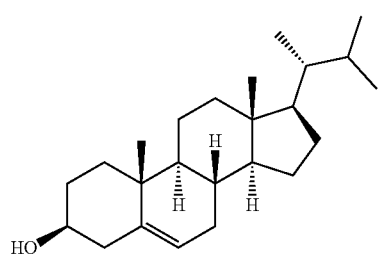
82
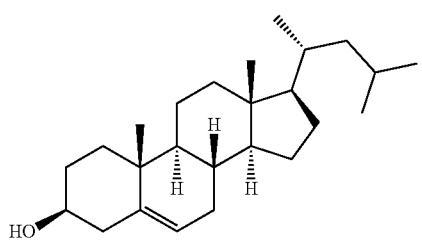
83
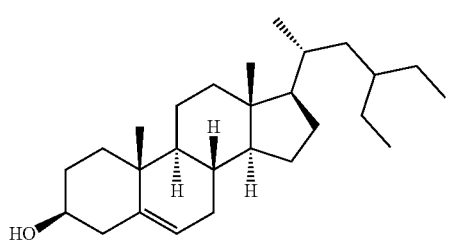

| | |
|---|---|
| 84 | 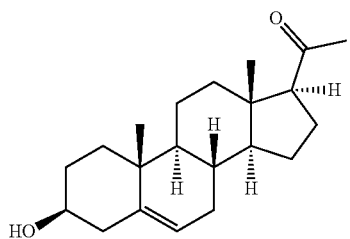 |
| 85 | 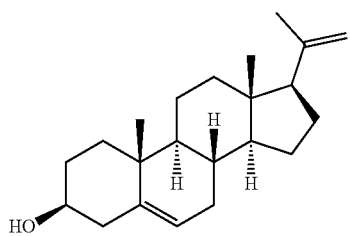 |
| 86 | 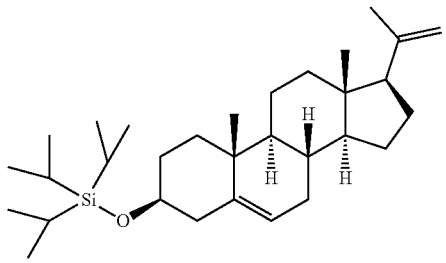 |
| 87 | 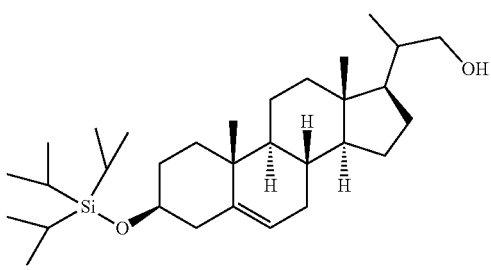 |
| 152 | 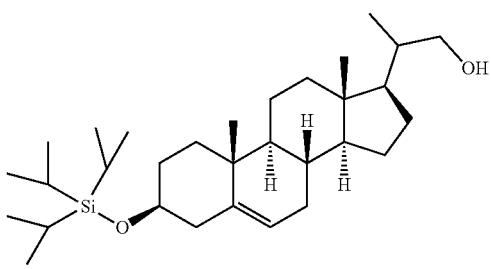 |
| 157 | 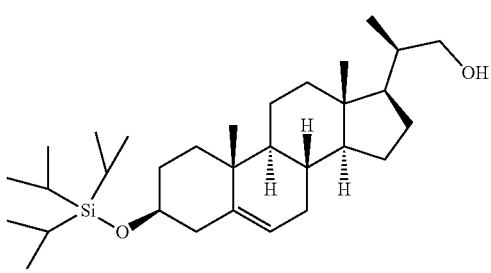 |

-continued
88
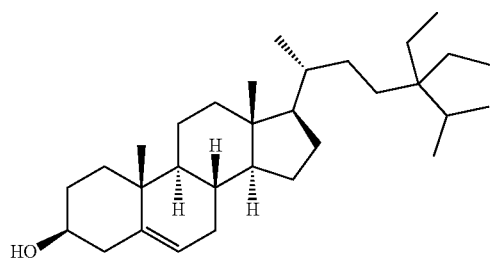
89
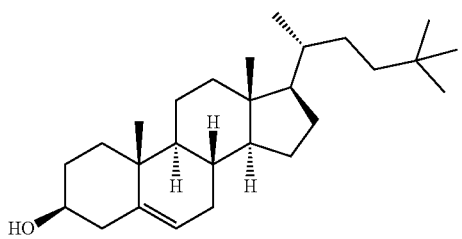
90
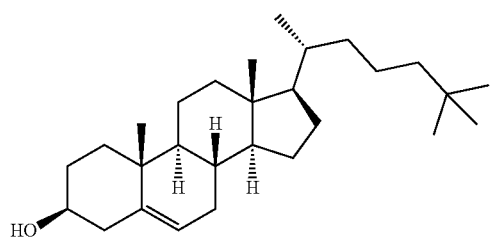
91
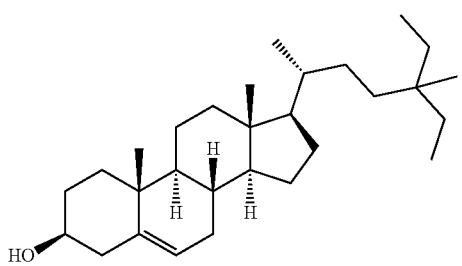
93
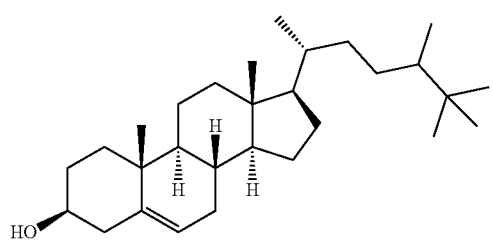
94
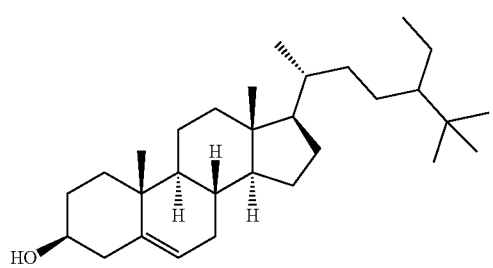

-continued
95
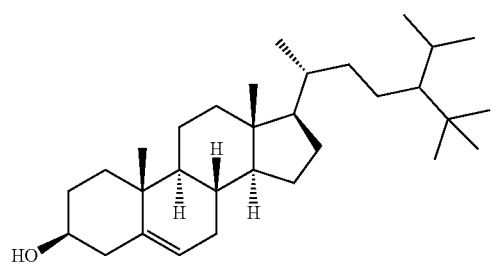
96
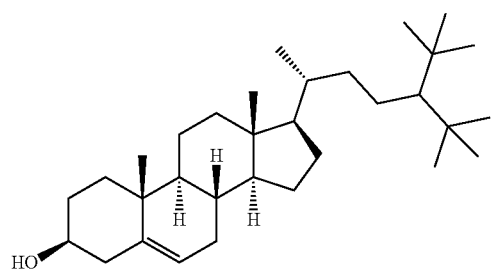
92
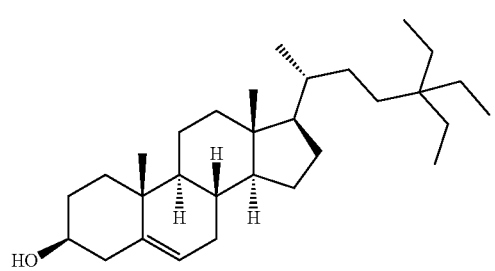
97
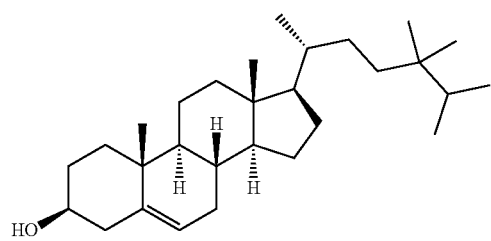
98
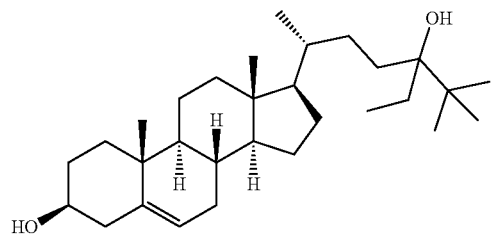
99
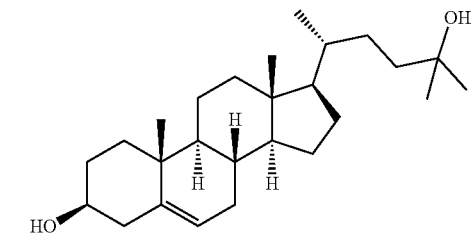

-continued
100
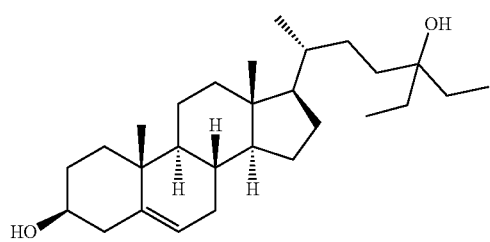
101
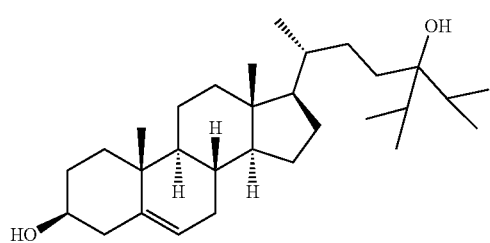
102
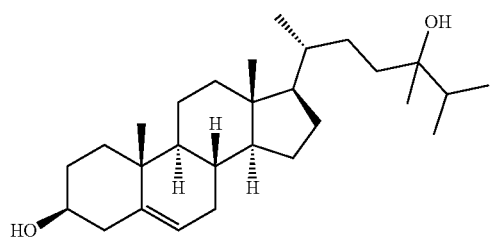
103
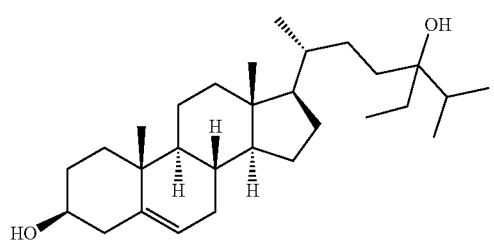
104
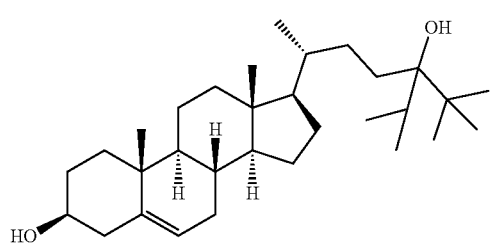
105
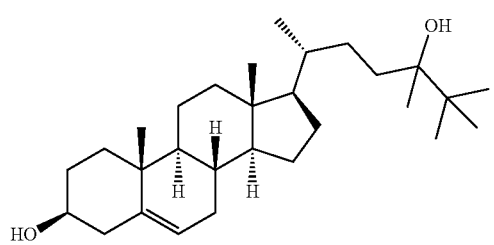

-continued
180
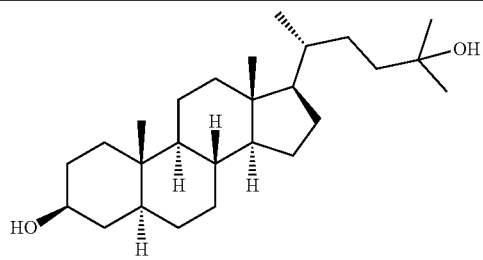
181
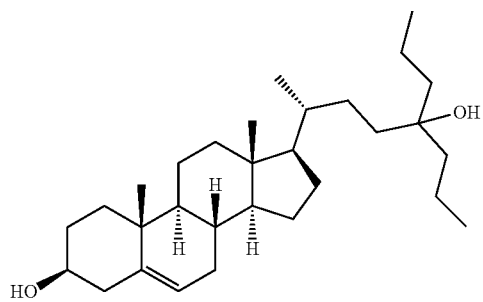
182
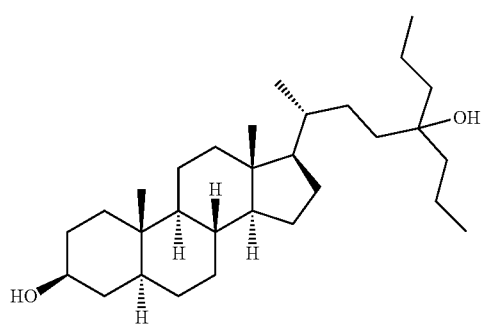
106
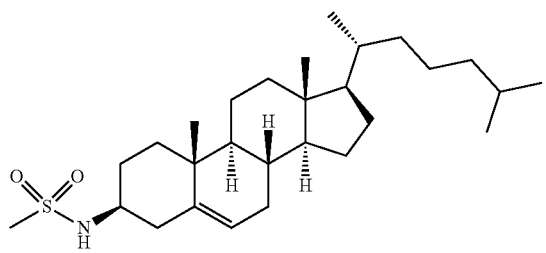
107
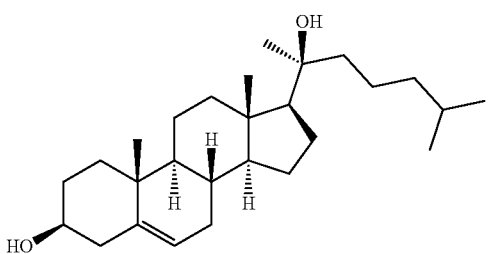
108
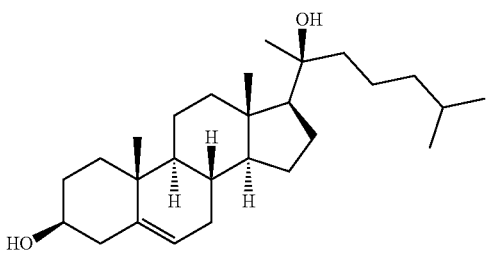

-continued
109
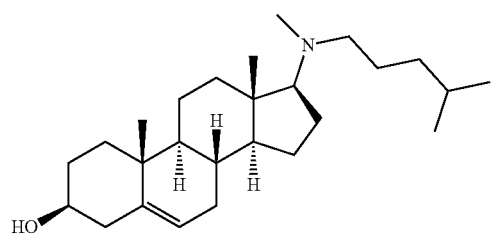
110
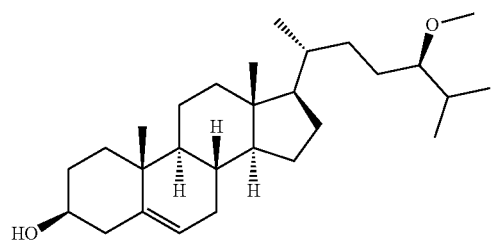
121
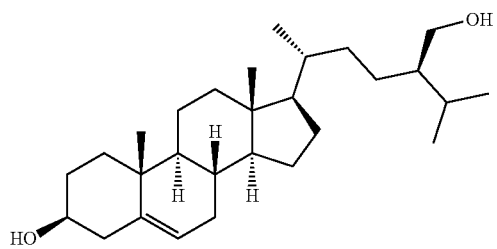
111
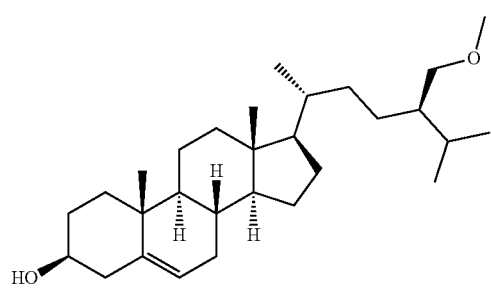
112
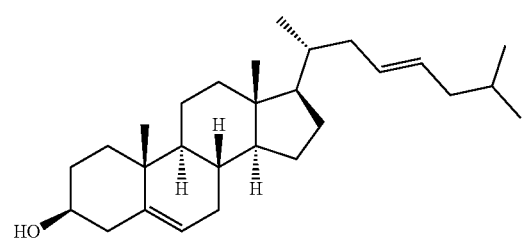
113
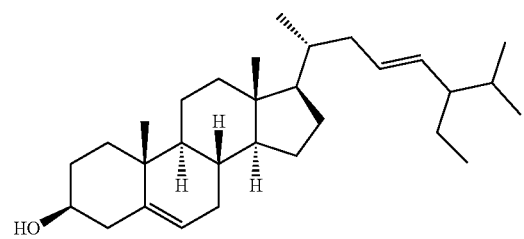

-continued
114
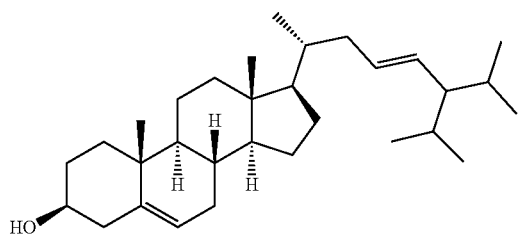
115
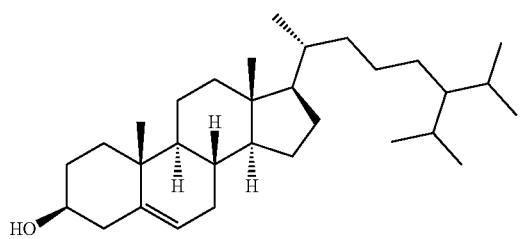
116
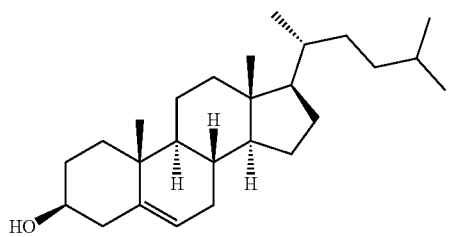
117
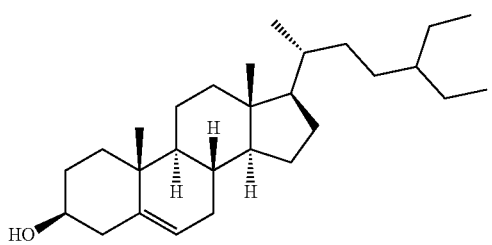
122
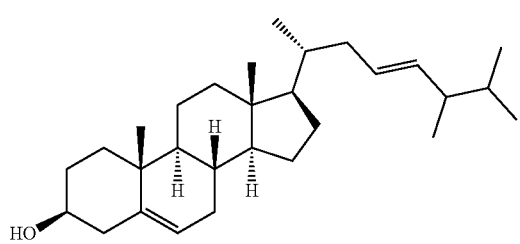
123
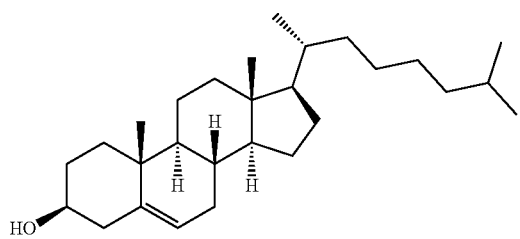

124 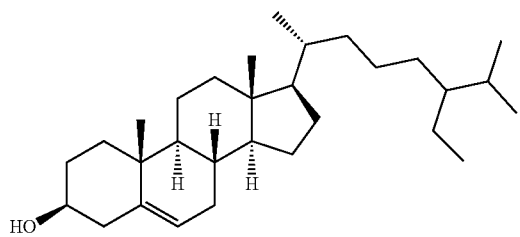
125 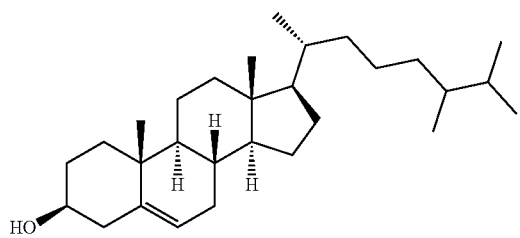
126 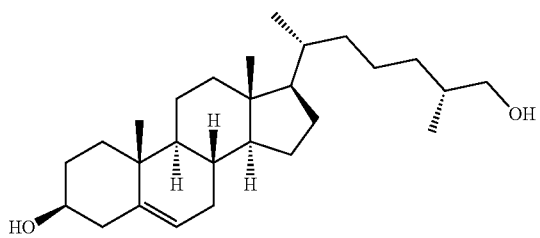
127 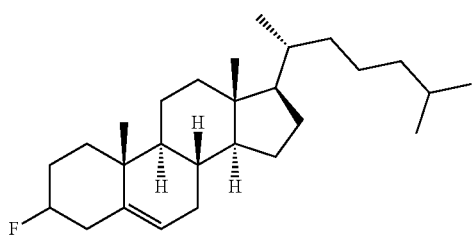
128 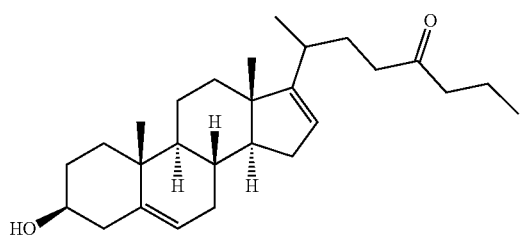
118 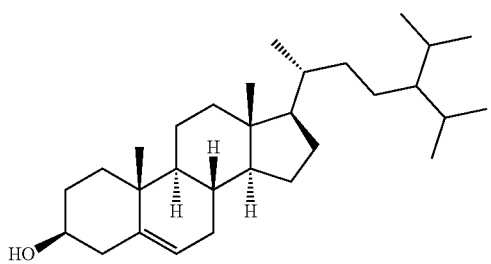

-continued
119
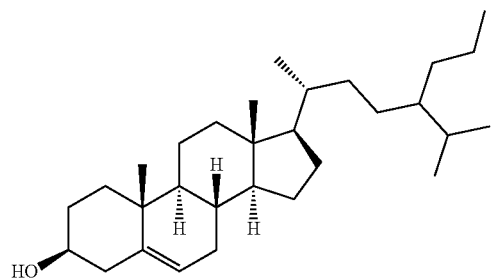
120
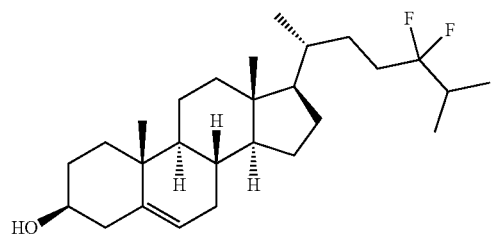
156
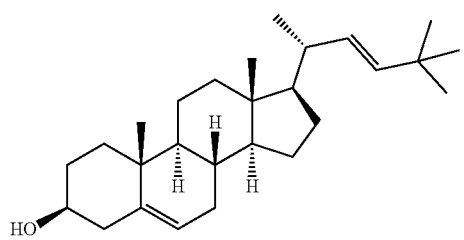
158
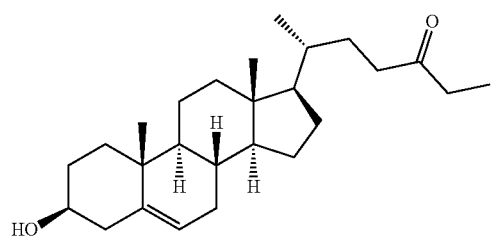
160
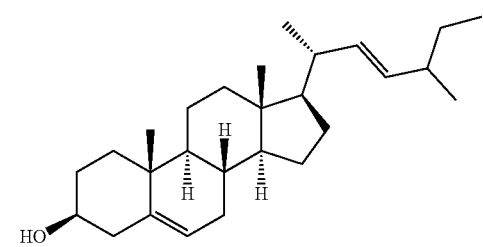
129
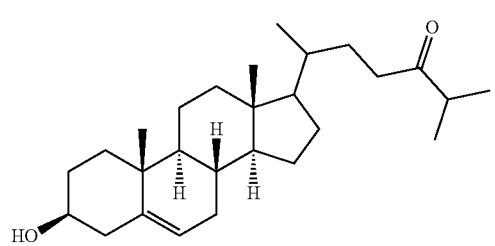

130 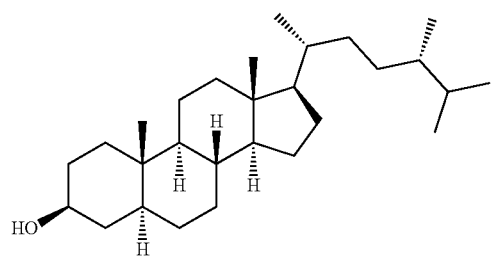
155 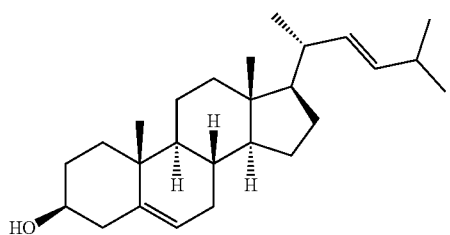
167 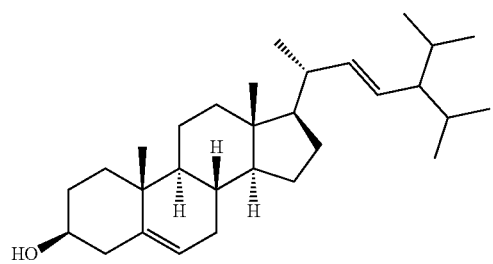
168 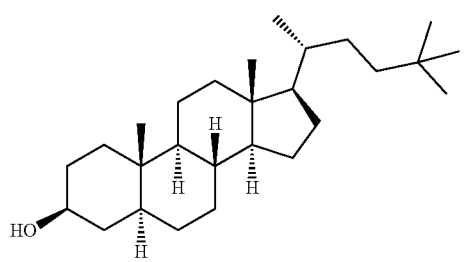
173 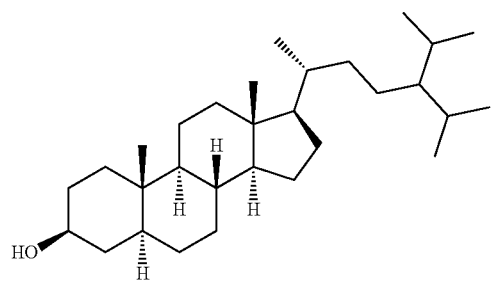
161 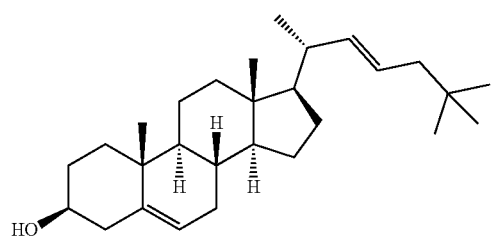

-continued
166
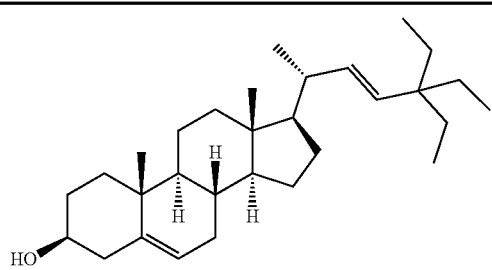
174
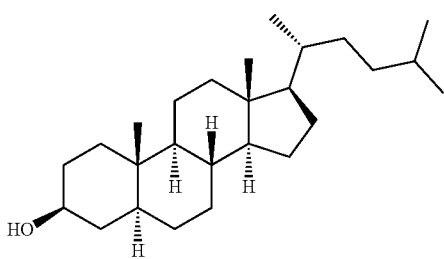
179
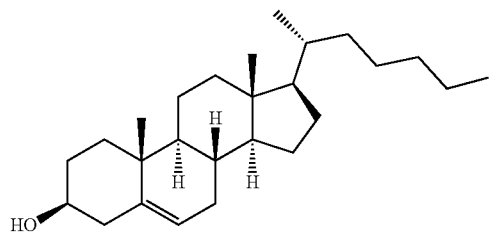
131
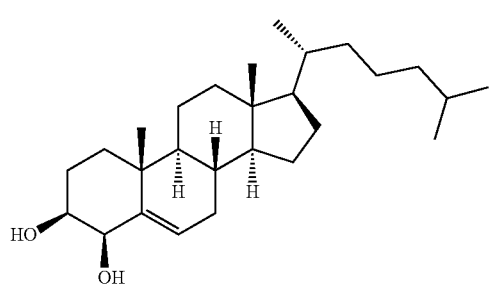
132
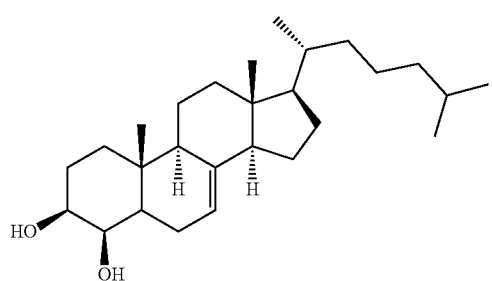
133
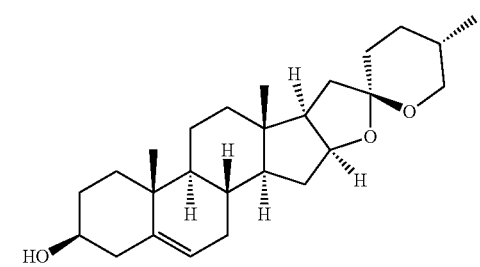

-continued
134
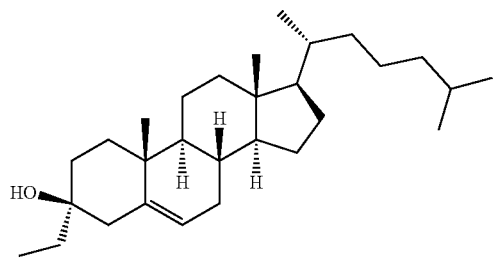
135
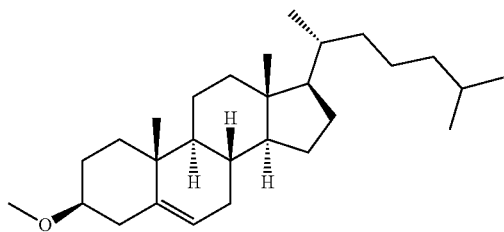
136
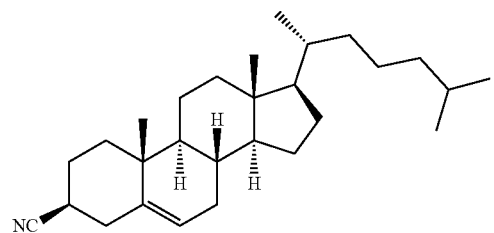
137
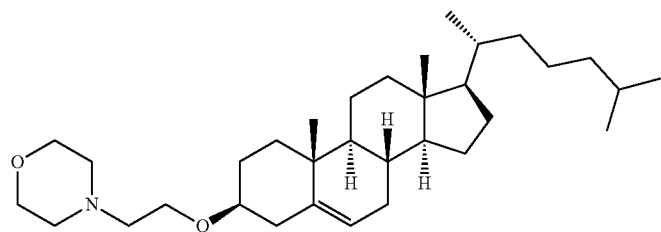
138
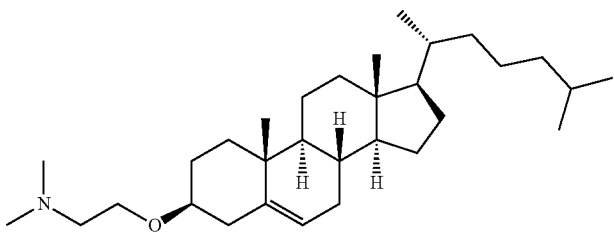
139
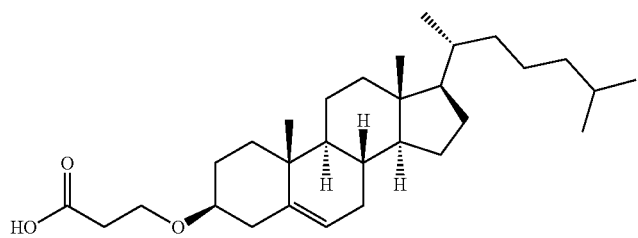

140
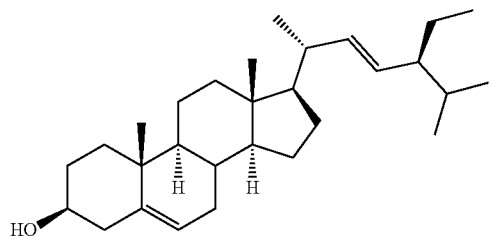
142
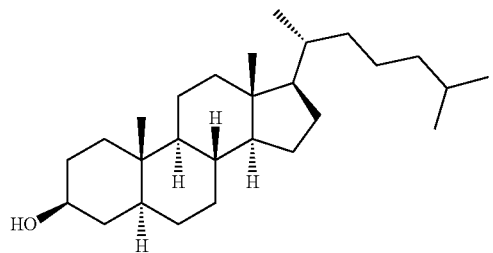
143
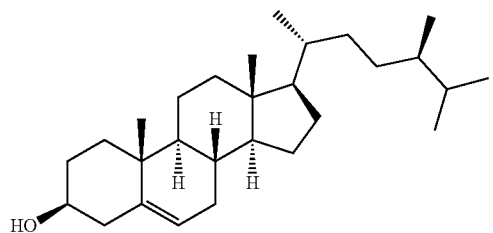
144
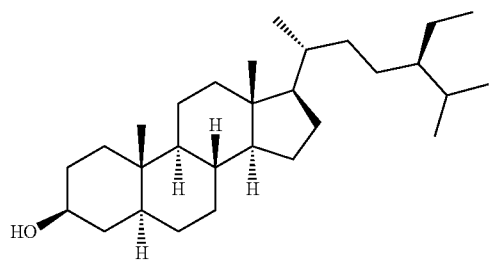
145
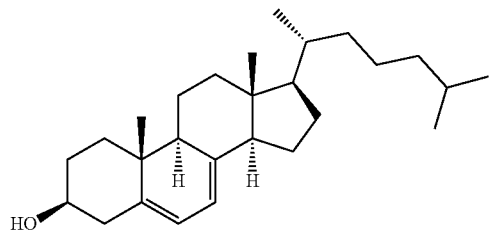
146
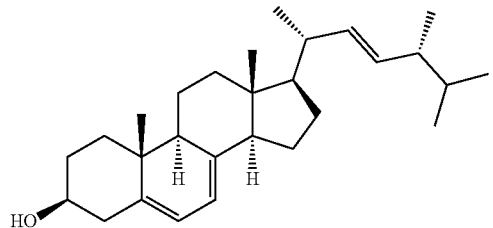

147
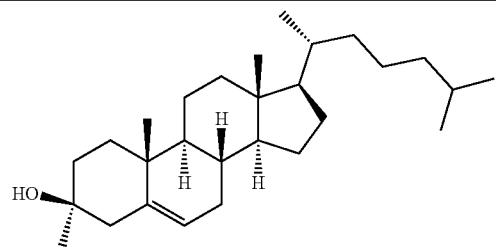
148
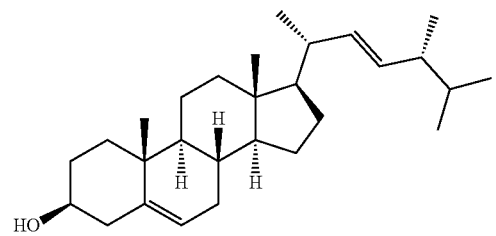
141
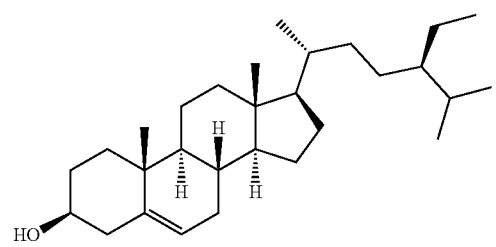
159
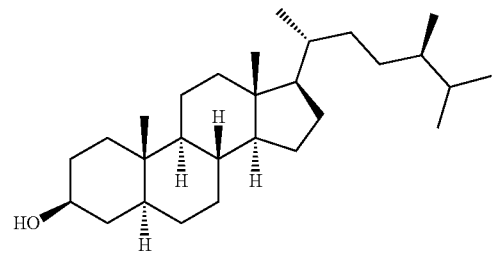
151
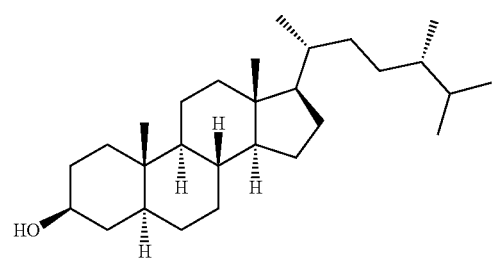
| Composition S-No. | Structure |
|---|---|
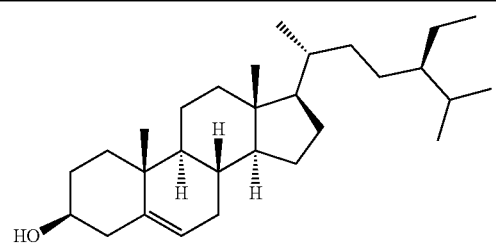
Compound 141

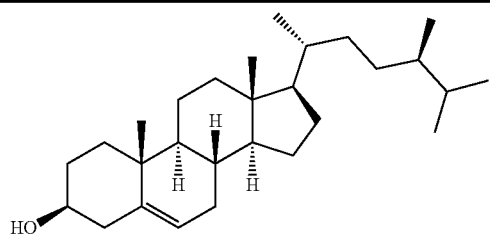

Compound 143

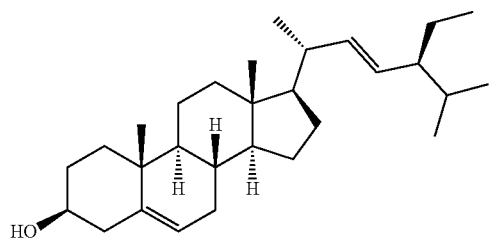

Compound 140

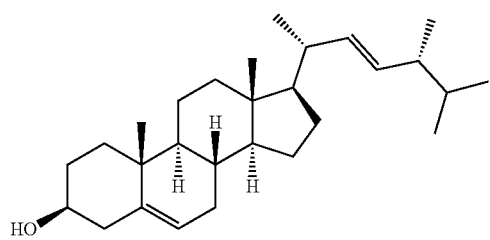

Compound 148

E. Lipid Nanoparticle (LNP) Formulations

The formation of a lipid nanoparticle (LNP) described herein may be accomplished by any methods known in the art. For example, as described in U.S. Pat. Pub. No. US2012/0178702 A1, which is incorporated herein by reference in its entirety. Non-limiting examples of lipid nanoparticle compositions and methods of making them are described, for example, in Semple et al. (2010) Nat. Biotechnol. 28:172-176; Jayarama et al. (2012), Angew. Chem. Int. Ed., 51:8529-8533; and Maier et al. (2013) Molecular Therapy 21, 1570-1578 (the contents of each of which are incorporated herein by reference in their entirety).

In one embodiment, the LNP formulation may be prepared by, e.g., the methods described in International Pat. Pub. No. WO 2011/127255 or WO 2008/103276, the contents of each of which are herein incorporated by reference in their entirety.

In one embodiment, LNP formulations described herein may comprise a polycationic composition. As a non-limiting example, the polycationic composition may be a composition selected from Formulae 1-60 of U.S. Pat. Pub. No. US2005/0222064 A1, the content of which is herein incorporated by reference in its entirety.

In one embodiment, the lipid nanoparticle may be formulated by the methods described in U.S. Pat. Pub. No. US2013/0156845 A1, and International Pat. Pub. No. WO2013/093648 A2 or WO2012/024526 A2, each of which is herein incorporated by reference in its entirety.

In one embodiment, the lipid nanoparticles described herein may be made in a sterile environment by the system and/or methods described in U.S. Pat. Pub. No. US2013/0164400 A1, which is incorporated herein by reference in its entirety.

In one embodiment, the LNP formulation may be formulated in a nanoparticle such as a nucleic acid-lipid particle described in U.S. Pat. No. 8,492,359, which is incorporated herein by reference in its entirety.

A nanoparticle composition may optionally comprise one or more coatings. For example, a nanoparticle composition may be formulated in a capsule, film, or tablet having a coating. A capsule, film, or tablet including a composition described herein may have any useful size, tensile strength, hardness, or density.

In some embodiments, the lipid nanoparticles described herein may be synthesized using methods comprising microfluidic mixers. Exemplary microfluidic mixers may include, but are not limited to, a slit interdigitial micromixer including, but not limited to, those manufactured by Precision Nanosystems (Vancouver, BC, Canada), Microinnova (Allerheiligen bei Wildon, Austria) and/or a staggered herringbone micromixer (SHM) (Zhigaltsev, I. V. et al. (2012) Langmuir. 28:3633-40; Belliveau, N. M. et al. Mol. Ther. Nucleic. Acids. (2012) 1:e37; Chen, D. et al. J. Am. Chem. Soc. (2012) 134(16):6948-51; each of which is herein incorporated by reference in its entirety).

In some embodiments, methods of LNP generation comprising SHM, further comprise the mixing of at least two input streams wherein mixing occurs by microstructure-induced chaotic advection (MICA). According to this method, fluid streams flow through channels present in a herringbone pattern causing rotational flow and folding the fluids around each other. This method may also comprise a surface for fluid mixing wherein the surface changes orientations during fluid cycling. Methods of generating LNPs using SHM include those disclosed in U.S. Pat. Pub. Nos. US2004/0262223 A1 and US2012/0276209 A1, each of which is incorporated herein by reference in their entirety.

In one embodiment, the lipid nanoparticles may be formulated using a micromixer such as, but not limited to, a Slit Interdigital Microstructured Mixer (SIMM-V2) or a Standard Slit Interdigital Micro Mixer (SSIMM) or Caterpillar (CPMM) or Impinging-jet (IJMM) from the Institut fur Mikrotechnik Mainz GmbH, Mainz Germany). In one embodiment, the lipid nanoparticles are created using microfluidic technology (see, Whitesides (2006) Nature. 442: 368-373; and Abraham et al. (2002) Science. 295: 647-651; each of which is herein incorporated by reference in its entirety). As a non-limiting example, controlled microfluidic formulation includes a passive method for mixing streams of steady pressure-driven flows in micro channels at a low Reynolds number (see, e.g., Abraham et al. (2002) Science. 295: 647651; which is herein incorporated by reference in its entirety).

In one embodiment, the circRNA of the present invention may be formulated in lipid nanoparticles created using a micromixer chip such as, but not limited to, those from Harvard Apparatus (Holliston, MA), Dolomite Microfluidics (Royston, UK), or Precision Nanosystems (Van Couver, BC, Canada). A micromixer chip can be used for rapid mixing of two or more fluid streams with a split and recombine mechanism.

In one embodiment, the lipid nanoparticles may have a diameter from about 10 to about 100 nm such as, but not limited to, about 10 to about 20 nm, about 10 to about 30 nm, about 10 to about 40 nm, about 10 to about 50 nm, about 10 to about 60 nm, about 10 to about 70 nm, about 10 to about 80 nm, about 10 to about 90 nm, about 20 to about 30 nm, about 20 to about 40 nm, about 20 to about 50 nm, about 20 to about 60 nm, about 20 to about 70 nm, about 20 to about 80 nm, about 20 to about 90 nm, about 20 to about 100 nm, about 30 to about 40 nm, about 30 to about 50 nm, about 30 to about 60 nm, about 30 to about 70 nm, about 30 to about 80 nm, about 30 to about 90 nm, about 30 to about 100 nm, about 40 to about 50 nm, about 40 to about 60 nm, about 40 to about 70 nm, about 40 to about 80 nm, about 40 to about 90 nm, about 40 to about 100 nm, about 50 to about 60 nm, about 50 to about 70 nm about 50 to about 80 nm, about 50 to about 90 nm, about 50 to about 100 nm, about 60 to about 70 nm, about 60 to about 80 nm, about 60 to about 90 nm, about 60 to about 100 nm, about 70 to about 80 nm, about 70 to about 90 nm, about 70 to about 100 nm, about 80 to about 90 nm, about 80 to about 100 nm and/or about 90 to about 100 nm. In one embodiment, the lipid nanoparticles may have a diameter from about 10 to 500 nm. In one embodiment, the lipid nanoparticle may have a diameter greater than 100 nm, greater than 150 nm, greater than 200 nm, greater than 250 nm, greater than 300 nm, greater than 350 nm, greater than 400 nm, greater than 450 nm, greater than 500 nm, greater than 550 nm, greater than 600 nm, greater than 650 nm, greater than 700 nm, greater than 750 nm, greater than 800 nm, greater than 850 nm, greater than 900 nm, greater than 950 nm or greater than 1000 nm. Each possibility represents a separate embodiment of the present invention.

In some embodiments, a nanoparticle (e.g., a lipid nanoparticle) has a mean diameter of 10-500 nm, 20-400 nm, 30-300 nm, or 40-200 nm. In some embodiments, a nanoparticle (e.g., a lipid nanoparticle) has a mean diameter of 50-150 nm, 50-200 nm, 80-100 nm, or 80-200 nm.

In some embodiments, the lipid nanoparticles described herein can have a diameter from below 0.1 μm to up to 1 mm such as, but not limited to, less than 0.1 μm, less than 1.0 μm, less than 5 μm, less than 10 μm, less than 15 μm, less than 20 μm, less than 25 μm, less than 30 μm, less than 35 μm, less than 40 μm, less than 50 μm, less than 55 μm, less than 60 μm, less than 65 μm, less than 70 μm, less than 75 μm, less than 80 μm, less than 85 μm, less than 90 μm, less than 95 μm, less than 100 μm, less than 125 μm, less than 150 μm, less than 175 μm, less than 200 μm, less than 225 μm, less than 250 μm, less than 275 μm, less than 300 μm, less than 325 μm, less than 350 μm, less than 375 μm, less than 400 μm, less than 425 μm, less than 450 μm, less than 475 μm, less than 500 μm, less than 525 μm, less than 550 μm, less than 575 μm, less than 600 μm, less than 625 μm, less than 650 μm, less than 675 μm, less than 700 μm, less than 725 μm, less than 750 μm, less than 775 μm, less than 800 μm, less than 825 μm, less than 850 μm, less than 875 μm, less than 900 μm, less than 925 μm, less than 950 μm, less than 975 μm.

In another embodiment, LNPs may have a diameter from about 1 nm to about 100 nm, from about 1 nm to about 10 nm, about 1 nm to about 20 nm, from about 1 nm to about 30 nm, from about 1 nm to about 40 nm, from about 1 nm to about 50 nm, from about 1 nm to about 60 nm, from about 1 nm to about 70 nm, from about 1 nm to about 80 nm, from about 1 nm to about 90 nm, from about 5 nm to about from 100 nm, from about 5 nm to about 10 nm, about 5 nm to about 20 nm, from about 5 nm to about 30 nm, from about 5 nm to about 40 nm, from about 5 nm to about 50 nm, from about 5 nm to about 60 nm, from about 5 nm to about 70 nm, from about 5 nm to about 80 nm, from about 5 nm to about 90 nm, about 10 to about 50 nM, from about 20 to about 50 nm, from about 30 to about 50 nm, from about 40 to about 50 nm, from about 20 to about 60 nm, from about 30 to about 60 nm, from about 40 to about 60 nm, from about 20 to about 70 nm, from about 30 to about 70 nm, from about 40 to about 70 nm, from about 50 to about 70 nm, from about 60 to about 70 nm, from about 20 to about 80 nm, from about 30 to about 80 nm, from about 40 to about 80 nm, from about 50 to about 80 nm, from about 60 to about 80 nm, from about 20 to about 90 nm, from about 30 to about 90 nm, from about 40 to about 90 nm, from about 50 to about 90 nm, from about 60 to about 90 nm and/or from about 70 to about 90 nm. Each possibility represents a separate embodiment of the present invention.

A nanoparticle composition may be relatively homogenous. A polydispersity index may be used to indicate the homogeneity of a nanoparticle composition, e.g., the particle size distribution of the nanoparticle compositions. A small (e.g., less than 0.3) polydispersity index generally indicates a narrow particle size distribution. A nanoparticle composition may have a polydispersity index from about 0 to about 0.25, such as 0.01, 0.02, 0.03, 0.04, 0.05, 0.06, 0.07, 0.08, 0.09, 0.10, 0.11, 0.12, 0.13, 0.14, 0.15, 0.16, 0.17, 0.18, 0.19, 0.20, 0.21, 0.22, 0.23, 0.24, or 0.25. In some embodiments, the polydispersity index of a nanoparticle composition may be from about 0.10 to about 0.20. Each possibility represents a separate embodiment of the present invention.

The zeta potential of a nanoparticle composition may be used to indicate the electrokinetic potential of the composition. For example, the zeta potential may describe the surface charge of a nanoparticle composition. Nanoparticle compositions with relatively low charges, positive or negative, are generally desirable, as more highly charged species may interact undesirably with cells, tissues, and other elements in the body. In some embodiments, the zeta potential of a nanoparticle composition may be from about −20 mV to about +20 mV, from about −20 mV to about +15 mV, from about −20 mV to about +10 mV, from about −20 mV to about +5 mV, from about −20 mV to about 0 mV, from about −20 mV to about −5 mV, from about −20 mV to about −10 mV, from about −20 mV to about −15 mV from about −20 mV to about +20 mV, from about −20 mV to about +15 mV, from about −20 mV to about +10 mV, from about −20 mV to about +5 mV, from about −20 mV to about 0 mV, from about 0 mV to about +20 mV, from about 0 mV to about +15 mV, from about 0 mV to about +10 mV, from about 0 mV to about +5 mV, from about +5 mV to about +20 mV, from about +5 mV to about +15 mV, or from about +5 mV to about +10 mV. Each possibility represents a separate embodiment of the present invention.

The efficiency of encapsulation of a therapeutic agent describes the amount of therapeutic agent that is encapsulated or otherwise associated with a nanoparticle composition after preparation, relative to the initial amount provided. The encapsulation efficiency is desirably high (e.g., close to 100%). The encapsulation efficiency may be measured, for example, by comparing the amount of therapeutic agent in a solution containing the nanoparticle composition before and after breaking up the nanoparticle composition with one or more organic solvents or detergents. Fluorescence may be used to measure the amount of free therapeutic agent (e.g., nucleic acids) in a solution. For the nanoparticle compositions described herein, the encapsulation efficiency of a therapeutic agent may be at least 50%, for example 50%, 55%, 60%, 65%, 70%, 75%, 80%, 85%, 90%, 91%, 92%, 93%, 94%, 95%, 96%, 97%, 98%, 99%, or 100%. In some embodiments, the encapsulation efficiency may be at least 80%. In certain embodiments, the encapsulation efficiency may be at least 90%. Each possibility represents a separate embodiment of the present invention. In some embodiments, the lipid nanoparticle has a polydiversity value of less than 0.4. In some embodiments, the lipid nanoparticle has a net neutral charge at a neutral pH. In some embodiments, the lipid nanoparticle has a mean diameter of 50-200 nm.

The properties of a lipid nanoparticle formulation may be influenced by factors including, but not limited to, the selection of the cationic lipid component, the degree of cationic lipid saturation, the selection of the non-cationic lipid component, the degree of noncationic lipid saturation, the selection of the structural lipid component, the nature of the PEGylation, ratio of all components and biophysical parameters such as size. As described herein, the purity of a PEG lipid component is also important to an LNP's properties and performance. The present invention contemplates the use of such lipid nanoparticle formulations as disclosed, for example, in International Application No. PCT/US2021/031629, in U.S. Provisional Application No. 63/022,248, filed on May 8, 2020; U.S. Provisional Application No. 63/087,582, filed on Oct. 5, 2020; and International Patent Application No. PCT/US2020/063494, filed on Dec. 4, 2020, the teachings of which are incorporated herein by reference in their entirety.

F. Methods for Lipid Nanoparticles (LNP)

In one embodiment, a lipid nanoparticle formulation may be prepared by the methods described in International Publication Nos. WO2011127255 or WO2008103276, each of which is herein incorporated by reference in their entirety. In some embodiments, lipid nanoparticle formulations may be as described in International Publication No. WO2019131770, which is herein incorporated by reference in its entirety.

In some embodiments, circular RNA is formulated according to a process described in U.S. patent application Ser. No. 15/809,680. In some embodiments, the present invention provides a process of encapsulating circular RNA in transfer vehicles comprising the steps of forming lipids into pre-formed transfer vehicles (i.e. formed in the absence of RNA) and then combining the pre-formed transfer vehicles with RNA. In some embodiments, the novel formulation process results in an RNA formulation with higher potency (peptide or protein expression) and higher efficacy (improvement of a biologically relevant endpoint) both in vitro and in vivo with potentially better tolerability as compared to the same RNA formulation prepared without the step of preforming the lipid nanoparticles (e.g., combining the lipids directly with the RNA).

For certain cationic lipid nanoparticle formulations of RNA, in order to achieve high encapsulation of RNA, the RNA in buffer (e.g., citrate buffer) has to be heated. In those processes or methods, the heating is required to occur before the formulation process (i.e. heating the separate components) as heating post-formulation (post-formation of nanoparticles) does not increase the encapsulation efficiency of the RNA in the lipid nanoparticles. In contrast, in some embodiments of the novel processes of the present invention, the order of heating of RNA does not appear to affect the RNA encapsulation percentage. In some embodiments, no heating (i.e. maintaining at ambient temperature) of one or more of the solutions comprising the pre-formed lipid nanoparticles, the solution comprising the RNA and the mixed solution comprising the lipid nanoparticle encapsulated RNA is required to occur before or after the formulation process.

RNA may be provided in a solution to be mixed with a lipid solution such that the RNA may be encapsulated in lipid nanoparticles. A suitable RNA solution may be any aqueous solution containing RNA to be encapsulated at various concentrations. For example, a suitable RNA solution may contain an RNA at a concentration of or greater than about 0.01 mg/ml, 0.05 mg/ml, 0.06 mg/ml, 0.07 mg/ml, 0.08 mg/ml, 0.09 mg/ml, 0.1 mg/ml, 0.15 mg/ml, 0.2 mg/ml, 0.3 mg/ml, 0.4 mg/ml, 0.5 mg/ml, 0.6 mg/ml, 0.7 mg/ml, 0.8 mg/ml, 0.9 mg/ml, or 1.0 mg/ml. In some embodiments, a suitable RNA solution may contain an RNA at a concentration in a range from about 0.01-1.0 mg/ml, 0.01-0.9 mg/ml, 0.01-0.8 mg/ml, 0.01-0.7 mg/ml, 0.01-0.6 mg/ml, 0.01-0.5 mg/ml, 0.01-0.4 mg/ml, 0.01-0.3 mg/ml, 0.01-0.2 mg/ml, 0.01-0.1 mg/ml, 0.05-1.0 mg/ml, 0.05-0.9 mg/ml, 0.05-0.8 mg/ml, 0.05-0.7 mg/ml, 0.05-0.6 mg/ml, 0.05-0.5 mg/ml, 0.05-0.4 mg/ml, 0.05-0.3 mg/ml, 0.05-0.2 mg/ml, 0.05-0.1 mg/ml, 0.1-1.0 mg/ml, 0.2-0.9 mg/ml, 0.3-0.8 mg/ml, 0.4-0.7 mg/ml, or 0.5-0.6 mg/ml.

Typically, a suitable RNA solution may also contain a buffering agent and/or salt. Generally, buffering agents can include HEPES, Tris, ammonium sulfate, sodium bicarbonate, sodium citrate, sodium acetate, potassium phosphate or sodium phosphate. In some embodiments, suitable concentration of the buffering agent may be in a range from about 0.1 mM to 100 mM, 0.5 mM to 90 mM, 1.0 mM to 80 mM, 2 mM to 70 mM, 3 mM to 60 mM, 4 mM to 50 mM, 5 mM to 40 mM, 6 mM to 30 mM, 7 mM to 20 mM, 8 mM to 15 mM, or 9 to 12 mM.

Exemplary salts can include sodium chloride, magnesium chloride, and potassium chloride. In some embodiments, suitable concentration of salts in an RNA solution may be in a range from about 1 mM to 500 mM, 5 mM to 400 mM, 10 mM to 350 mM, 15 mM to 300 mM, 20 mM to 250 mM, 30 mM to 200 mM, 40 mM to 190 mM, 50 mM to 180 mM, 50 mM to 170 mM, 50 mM to 160 mM, 50 mM to 150 mM, or 50 mM to 100 mM.

In some embodiments, a suitable RNA solution may have a pH in a range from about 3.5-6.5, 3.5-6.0, 3.5-5.5, 3.5-5.0, 3.5-4.5, 4.0-5.5, 4.0-5.0, 4.0-4.9, 4.0-4.8, 4.0-4.7, 4.0-4.6, or 4.0-4.5.

Various methods may be used to prepare an RNA solution suitable for the present invention. In some embodiments, RNA may be directly dissolved in a buffer solution described herein. In some embodiments, an RNA solution may be generated by mixing an RNA stock solution with a buffer solution prior to mixing with a lipid solution for encapsulation. In some embodiments, an RNA solution may be generated by mixing an RNA stock solution with a buffer solution immediately before mixing with a lipid solution for encapsulation.

According to the present invention, a lipid solution contains a mixture of lipids suitable to form transfer vehicles for encapsulation of RNA. In some embodiments, a suitable lipid solution is ethanol based. For example, a suitable lipid solution may contain a mixture of desired lipids dissolved in pure ethanol (i.e. 100% ethanol). In another embodiment, a suitable lipid solution is isopropyl alcohol based. In another embodiment, a suitable lipid solution is dimethylsulfoxide-based. In another embodiment, a suitable lipid solution is a mixture of suitable solvents including, but not limited to, ethanol, isopropyl alcohol and dimethylsulfoxide.

A suitable lipid solution may contain a mixture of desired lipids at various concentrations. In some embodiments, a suitable lipid solution may contain a mixture of desired lipids at a total concentration in a range from about 0.1-100 mg/ml, 0.5-90 mg/ml, 1.0-80 mg/ml, 1.0-70 mg/ml, 1.0-60 mg/ml, 1.0-50 mg/ml, 1.0-40 mg/ml, 1.0-30 mg/ml, 1.0-20 mg/ml, 1.0-15 mg/ml, 1.0-10 mg/ml, 1.0-9 mg/ml, 1.0-8 mg/ml, 1.0-7 mg/ml, 1.0-6 mg/ml, or 1.0-5 mg/ml.

G. Liposomes

In certain embodiments, liposomes or other lipid bilayer vesicles are disclosed herein and may be used as a component or as the whole transfer vehicle to facilitate or enhance the delivery and release of circular RAN to one or more target cells. Liposomes are usually characterized by having an interior space sequestered from an outer medium by a membrane of one or more bilayers forming a microscopic sack or vesicle. Bilayer membranes of liposomes are typically formed by lipids, i.e. amphiphilic molecules of synthetic or natural origin that comprise spatially separated hydrophobic or hydrophilic domains (Lasic, D, and Papahadjopoulos, D., eds. Medical Applications of Liposomes. Elsevier, Amsterdam, 1998).

In some embodiments, the circular RNA is encapsulated, or the liposome can be prepared using various methods, including but not limited to mechanical dispersion, solvent dispersion, and or detergent removal. Each of these methods include the steps of drying the lipids from organic solvents, dispersing the lipid in aqueous media, resizing the liposomes and purifying the/liposome suspension (Gomez et al., ACS Omega. 2019. 4(6): 10866-10876). Various other methods of liposome preparation can be found in Akbarzadeh et al., Nanoscale Res Lett. 2013; 8(1): 102. In some embodiments, the circular RNA may be loaded passively (i.e. the circular RNA is encapsulated during liposome formation) or actively (i.e. after liposome formation).

In some embodiments, the liposome disclosed herein may comprise one or more bilayers. In certain embodiments, the liposome may comprise a multilamellar vesicle or a unilamellar vesicle.

In certain embodiments, the liposome as described herein comprises of naturally derived or engineered phospholipids. In some embodiments, the liposomes may further comprise PEG-lipids that aid with stability of the overall liposome structure. Other improvements, including but not limited to corticosteroid and other steroids may be used to help with maintaining structure and stability of the liposome.

Dendrimer

In certain embodiments, the transfer vehicle for transporting the circular RNA comprises a dendrimer. Use of "dendrimer" describes the architectural motif of the transfer vehicle. In some embodiments, the dendrimer includes but is not limited to containing an interior core and one or more layers (i.e. generations) that extend or attach out from the interior core. In some of the embodiments, the generations may contain one or more branching points and an exterior surface of terminal groups that attach to the outermost generation. The branching points, in certain embodiments, may be mostly monodispersed and contain symmetric branching units built around the interior core. In some embodiments, the interior core Synthesis of the dendrimer may comprise the divergent method, convergent growth, hypercore and branched monomer growth, double exponential growth, lego chemistry, click chemistry and other methods as available in the art (Mendes L. et al., Molecules. 2017. 22 (9): 1401 further describes these methods).

H. Polymer-Based Delivery

In certain embodiments, as described herein, the transfer vehicle for the circular RNA polynucleotide comprises a polymer nanoparticle. In some embodiments, the polymer nanoparticle includes nanocapsules and nanospheres. Nanocapsules, in some embodiments, are composed of an oily core surrounded by a polymeric shell. In some embodiments, the circular RNA is contained within the core and the polymeric shell controls the release of the circular RNA. On the other hand, nanospheres comprise a continuous polymeric network in which the circular RNA is retained or absorbed onto the surface. In some embodiments, cationic polymers is used to encapsulate the circular RNA due to the favorable electrostatic interaction of the cations to the negatively charged nucleic acids and cell membrane.

The polymer nanoparticle may be prepared by various methods. In some embodiments, the polymer nanoparticle may be prepared by nanoprecipitation, emulsion techniques, solvent evaporation, solvent diffusion, reverse salting-out or other methods available in the art.

I. Polymer-Lipid Hybrids

In certain embodiments, as described herein, the transfer vehicle for the circular RNA polynucleotide comprises a polymer-lipid hybrid nanoparticle (LPHNP). In some embodiments, the LPHNP comprises a polymer core enveloped within a lipid bilayer. In some embodiments, the polymer core encapsulates the circular RNA polynucleotide. In some embodiments, the LPHNP further comprises an outer lipid bilayer. In certain embodiments this outer lipid bilayer comprises a PEG-lipid, helper lipid, cholesterol or other molecule as known in the art to help with stability in a lipid-based nanoparticle. The lipid bilayer closest to the polymer core mitigates the loss of the entrapped circular RNA during LPHNP formation and protects from degradation of the polymer core by preventing diffusion of water from outside of the transfer vehicle into the polymer core (Mukherjee et al., In J. Nanomedicine. 2019; 14: 1937-1952).

There are various methods of developing and formulating a LPHNP. In certain embodiments, the LPHNP is developed using a one-step or a two-step method available in the art. In some embodiments, the one-step method for forming an LPHNP is through nanoprecipitation or emulsification-solvent evaporation. In certain embodiments, the two-step method includes nanoprecipitation, emulsification-solvent evaporation, high-pressure homogenization, or other method available in the art.

J. Peptide-Based Delivery

In certain embodiments, the circular RNA can be transported using a peptide-based delivery mechanism. In some embodiments, the peptide-based delivery mechanism comprises a lipoprotein. Based on the size of the drug to be delivered, the lipoprotein may be either a low-density (LDL) or high-density lipoprotein (HDL). As seen in U.S. Pat. No. 8,734,853B2, high-density lipoproteins are capable of transporting a nucleic acid in vivo and in vitro.

In particular embodiments, the lipid component includes cholesterol. In more particular embodiments, the lipid component includes a combination of cholesterol and cholesterol oleate.

The HDL-nucleic acid particle can be of any size, but in particular embodiments the particle has a molecular size of from about 100 Angstroms to about 500 Angstroms. In more particular embodiments, the particle has a molecular size of from about 100 Angstroms to about 300 Angstroms. The size may be dependent on the size of the nucleic acid component incorporated into the particle.

The HDL-nucleic acid particle can have a broad range in molecular weight. The weight is dependent on the size of the nucleic acid incorporated into the particle. For example, in some embodiments, the particle has a molecular weight of between about 100,000 Daltons to about 1,000,000 Daltons. In more particular embodiments, the particle has a molecular weight of between about 100,000 Daltons to about 500,000 Daltons. In specific embodiments, the particle has a molecular weight of between about 100,000 Daltons to about 300,000 Daltons.

The HDL-nucleic acid particles of the present invention can be made by different methods. For example, a nucleic acid (e.g., siRNA) may be neutralized by combining the nucleic acid with peptides or polypeptides composed of contiguous positively-charged amino acids. For example, as discussed above, amino acid sequences may include 2 or more contiguous lysine residues. The positive charge of the amino acid sequences neutralizes the negatively charged nucleic acid molecule. The nucleic acid can then be encapsulated in an HDL particle using a method as described in Lacko et al. (2002).

K. Carbohydrate Carrier

In certain embodiments, the circular RNA polynucleotide can be transported using a carbohydrate carrier or a sugar-nanocapsule. In certain embodiments, the carbohydrate carrier comprises a sugar-decorated nanoparticle, peptide- and saccharide-conjugated dendrimer, nanoparticles based on polysaccharides, and other carbohydrate-based carriers available in the art. As described herein, the incorporation of carbohydrate molecules may be through synthetic means.

In some embodiments, the carbohydrate carrier comprises polysaccharides. These polysaccharides may be made from the microbial cell wall of the target cell. For example, carbohydrate carriers comprise of mannan carbohydrates have been shown to successfully deliver mRNA (Son et al., Nano Lett. 2020. 20(3): 1499-1509).

L. Glycan-Decorated Nanoparticles/Glyconanoparticles

In certain embodiments, as provided herein, the transfer vehicle for the circular RNA is a glyconanoparticle (GlycoNP). As known in the art, glyconanoparticles comprise a core comprising gold, iron oxide, semiconductor nanoparticles or a combination thereof. In some embodiments, the glyconanoparticle is functionalized using carbohydrates. In certain embodiments, the glyconanoparticle comprises a carbon nanotube or graphene. In one embodiment the glyconanoparticle comprises a polysaccharide-based GlycoNP (e.g., chitosan-based GlycoNP). In certain embodiments, the glyconanoparticle is a glycodendrimer.

M. Exosomes, Fusome & Organelle-Based Delivery Systems

In certain embodiments, as provided herein, the circular RNA is transferred through use of an exosome, a type of extracellular vesicle. Exosomes naturally are secreted by various types of cells and are used as a transport vesicle for various forms of cargo. During delivery exosomes can contain and protecting specific mRNAs, regulatory microRNAs, lipids, and proteins (Luan et al., Acta Pharmacologica Sinica. 2017. 38:754-763). Naturally, exosomes may be 30 nm to 125 nm.

In some embodiments, the exosome may be made in part from an immune cell. As shown in Haney et al, use of immune cell derived exosomes are able to avoid mononuclear phagocytes (J Control Release. 2015. 207:18-30). In some embodiments, the exosome may be a dendritic cell, macrophage, T-cell, B-cell or derived from another immune cell. As seen in WO/2021/041473A1, various forms of RNAs of varying lengths may be transported through exosome delivery including messenger RNA (mRNA), microRNA (miRNA), long intergenic non-coding RNA (lincRNA), long non-coding RNA (lncRNA), non-coding RNA (ncRNA), non-messenger RNA (nmRNA), small RNA (sRNA), small non-messenger RNA (smnRNA), DNA damage response RNA (DD RNA), extracellular RNA (exRNA), small nuclear RNA (snRNA), small nucleolar RNA (snoRNA), and precursor messenger RNA (pre-mRNA).

In other embodiments, the transfer vehicle may comprise in whole or in part from a fusome. In some embodiments, the fusome is derived from an endoplasmic reticulum of a germline cyst. In certain embodiments, the germline cyst is from a *Drosophila* ovary.

N. Microneedles, Electroporation, Continuous Pumps, & Gene Gun

In certain embodiments, the circular RNA polynucleotide may be transported using noncellular and instead be through mechanical delivery mechanisms. In some embodiments, this delivery method includes microneedles, electroporation, continuous pumps and/or gene guns.

Various methods and apparatuses have been developed for microneedling a nucleic acid into a specific set of cells. A method for delivery of biological material across the biological tissue has been described by Kodgule et al and is taught for example in US 2011/0196308, the contents of which are incorporated herein by reference in their entirety. According to Kodgule, multiple biodegradable microneedles containing a therapeutic active ingredient are incorporated in a device which delivers proteins, carbohydrates, nucleic acid molecules, lipids and other pharmaceutically active ingredients or combinations thereof.

Intradermal delivery of biologically active agents by needle-free injection and electroporation has been described by Hoffmann et al and is taught for example in U.S. Pat. No.

7,171,264 the contents of which are incorporated herein by reference in their entirety. According to Hoffmann, one or more needle-free injectors are incorporated into an electroporation device and the combination of needle-free injection and electroporation is sufficient to introduce the agent into cells in skin, muscle or mucosa. In certain embodiments, the electroporation is through a continuous-flow microfluidic electroporation.

O. Pharmaceutical Salts, Buffers, & Solutions

In some embodiments, the transfer vehicle of the circular RNA polynucleotide is a solution or diluent comprising of a salt or a buffer.

7. Combinations of Proteins and IRES

In certain embodiments, as provided herein, the payload encoded by the circular RNA polynucleotide may be optimized through use of a specific internal ribosome entry sites (IRES) within the translation initiation element (TIE). In some embodiments, IRES specificity within a circular RNA can significantly enhance expression of specific proteins encoded within the coding element.

8. Targeting

A. Targeting Methods

The present invention also contemplates the discriminatory targeting of target cells and tissues by both passive and active targeting means. The phenomenon of passive targeting exploits the natural distributions patterns of a transfer vehicle in vivo without relying upon the use of additional excipients or means to enhance recognition of the transfer vehicle by target cells. For example, transfer vehicles which are subject to phagocytosis by the cells of the reticuloendothelial system are likely to accumulate in the liver or spleen, and accordingly may provide a means to passively direct the delivery of the compositions to such target cells.

Alternatively, the present invention contemplates active targeting, which involves the use of targeting moieties that may be bound (either covalently or non-covalently) to the transfer vehicle to encourage localization of such transfer vehicle at certain target cells or target tissues. For example, targeting may be mediated by the inclusion of one or more endogenous targeting moieties in or on the transfer vehicle to encourage distribution to the target cells or tissues. Recognition of the targeting moiety by the target tissues actively facilitates tissue distribution and cellular uptake of the transfer vehicle and/or its contents in the target cells and tissues (e.g., the inclusion of an apolipoprotein-E targeting ligand in or on the transfer vehicle encourages recognition and binding of the transfer vehicle to endogenous low density lipoprotein receptors expressed by hepatocytes). As provided herein, the composition can comprise a moiety capable of enhancing affinity of the composition to the target cell. Targeting moieties may be linked to the outer bilayer of the lipid particle during formulation or post-formulation. These methods are well known in the art. In addition, some lipid particle formulations may employ fusogenic polymers such as PEAA, hemagluttinin, other lipopeptides (see U.S. patent application Ser. No. 08/835,281, and 60/083,294, which are incorporated herein by reference) and other features useful for in vivo and/or intracellular delivery. In other some embodiments, the compositions of the present invention demonstrate improved transfection efficacies, and/or demonstrate enhanced selectivity towards target cells or tissues of interest. Contemplated therefore are compositions which comprise one or more moieties (e.g., peptides, aptamers, oligonucleotides, a vitamin or other molecules) that are capable of enhancing the affinity of the compositions and their nucleic acid contents for the target cells or tissues. Suitable moieties may optionally be bound or linked to the surface of the transfer vehicle. In some embodiments, the targeting moiety may span the surface of a transfer vehicle or be encapsulated within the transfer vehicle. Suitable moieties and are selected based upon their physical, chemical or biological properties (e.g., selective affinity and/or recognition of target cell surface markers or features). Cell-specific target sites and their corresponding targeting ligand can vary widely. Suitable targeting moieties are selected such that the unique characteristics of a target cell are exploited, thus allowing the composition to discriminate between target and non-target cells. For example, compositions of the invention may include surface markers (e.g., apolipoprotein-B or apolipoprotein-E) that selectively enhance recognition of, or affinity to hepatocytes (e.g., by receptor-mediated recognition of and binding to such surface markers). As an example, the use of galactose as a targeting moiety would be expected to direct the compositions of the present invention to parenchymal hepatocytes, or alternatively the use of mannose containing sugar residues as a targeting ligand would be expected to direct the compositions of the present invention to liver endothelial cells (e.g., mannose containing sugar residues that may bind preferentially to the asialoglycoprotein receptor present in hepatocytes). (See Hillery A M, et al. "Drug Delivery and Targeting: For Pharmacists and Pharmaceutical Scientists" (2002) Taylor & Francis, Inc.) The presentation of such targeting moieties that have been conjugated to moieties present in the transfer vehicle (e.g., a lipid nanoparticle) therefore facilitate recognition and uptake of the compositions of the present invention in target cells and tissues. Examples of suitable targeting moieties include one or more peptides, proteins, aptamers, vitamins and oligonucleotides.

In particular embodiments, a transfer vehicle comprises a targeting moiety. In some embodiments, the targeting moiety mediates receptor-mediated endocytosis selectively into a specific population of cells. In some embodiments, the targeting moiety is capable of binding to a T cell antigen. In some embodiments, the targeting moiety is capable of binding to a NK, NKT, or macrophage antigen. In some embodiments, the targeting moiety is capable of binding to a protein selected from the group CD3, CD4, CD8, PD-1, 4-1BB, and CD2. In some embodiments, the targeting moiety is an single chain Fv (scFv) fragment, nanobody, peptide, peptide-based macrocycle, minibody, heavy chain variable region, light chain variable region or fragment thereof. In some embodiments, the targeting moiety is selected from T-cell receptor motif antibodies, T-cell α chain antibodies, T-cell β chain antibodies, T-cell γ chain antibodies, T-cell δ chain antibodies, CCR7 antibodies, CD3 antibodies, CD4 antibodies, CD5 antibodies, CD7 antibodies, CD8 antibodies, CD11b antibodies, CD11c antibodies, CD16 antibodies, CD19 antibodies, CD20 antibodies, CD21 antibodies, CD22 antibodies, CD25 antibodies, CD28 antibodies, CD34 antibodies, CD35 antibodies, CD40 antibodies, CD45RA antibodies, CD45RO antibodies, CD52 antibodies, CD56 antibodies, CD62L antibodies, CD68 antibodies, CD80 antibodies, CD95 antibodies, CD 117 antibodies, CD127 antibodies, CD133 antibodies, CD137 (4-1BB) antibodies, CD163 antibodies, F4/80 antibodies, IL-4Rα antibodies, Sca-1 antibodies, CTLA-4 antibodies, GITR antibodies GARP antibodies, LAP antibodies, granzyme B antibodies, LFA-1 antibodies, transferrin receptor antibodies, and fragments thereof. In some embodiments, the targeting moiety is a small molecule binder of an ectoenzyme on lymphocytes. Small molecule binders of ectoenzymes include A2A inhibitors CD73 inhibitors, CD39 or adesines receptors A2aR and A2bR. Potential small molecules include AB928.

In some embodiments, transfer vehicles are formulated and/or targeted as described in Shobaki N, Sato Y, Harashima H. Mixing lipids to manipulate the ionization status of lipid nanoparticles for specific tissue targeting. Int J Nanomedicine. 2018; 13:8395-8410. Published 2018 Dec. 10. In some embodiments, a transfer vehicle is made up of 3 lipid types. In some embodiments, a transfer vehicle is made up of 4 lipid types. In some embodiments, a transfer vehicle is made up of 5 lipid types. In some embodiments, a transfer vehicle is made up of 6 lipid types.

B. Target Cells

Where it is desired to deliver a nucleic acid to an immune cell, the immune cell represents the target cell. In some embodiments, the compositions of the invention transfect the target cells on a discriminatory basis (i.e., do not transfect non-target cells). The compositions of the invention may also be prepared to preferentially target a variety of target cells, which include, but are not limited to, T cells, B cells, macrophages, and dendritic cells.

In some embodiments, the target cells are deficient in a protein or enzyme of interest. For example, where it is desired to deliver a nucleic acid to a hepatocyte, the hepatocyte represents the target cell. In some embodiments, the compositions of the invention transfect the target cells on a discriminatory basis (i.e., do not transfect non-target cells). The compositions of the invention may also be prepared to preferentially target a variety of target cells, which include, but are not limited to, hepatocytes, epithelial cells, hematopoietic cells, epithelial cells, endothelial cells, lung cells, bone cells, stem cells, mesenchymal cells, neural cells (e.g., meninges, astrocytes, motor neurons, cells of the dorsal root ganglia and anterior horn motor neurons), photoreceptor cells (e.g., rods and cones), retinal pigmented epithelial cells, secretory cells, cardiac cells, adipocytes, vascular smooth muscle cells, cardiomyocytes, skeletal muscle cells, beta cells, pituitary cells, synovial lining cells, ovarian cells, testicular cells, fibroblasts, B cells, T cells, reticulocytes, leukocytes, granulocytes and tumor cells.

The compositions of the invention may be prepared to preferentially distribute to target cells such as in the heart, lungs, kidneys, liver, and spleen. In some embodiments, the compositions of the invention distribute into the cells of the liver or spleen to facilitate the delivery and the subsequent expression of the circRNA comprised therein by the cells of the liver (e.g., hepatocytes) or the cells of spleen (e.g., immune cells). The targeted cells may function as a biological "reservoir" or "depot" capable of producing, and systemically excreting a functional protein or enzyme. Accordingly, in one embodiment of the invention the transfer vehicle may target hepatocytes or immune cells and/or preferentially distribute to the cells of the liver or spleen upon delivery. In an embodiment, following transfection of the target hepatocytes or immune cells, the circRNA loaded in the vehicle are translated and a functional protein product is produced, excreted and systemically distributed. In other embodiments, cells other than hepatocytes (e.g., lung, spleen, heart, ocular, or cells of the central nervous system) can serve as a depot location for protein production.

In one embodiment, the compositions of the invention facilitate a subject's endogenous production of one or more functional proteins and/or enzymes. In an embodiment of the present invention, the transfer vehicles comprise circRNA which encode a deficient protein or enzyme. Upon distribution of such compositions to the target tissues and the subsequent transfection of such target cells, the exogenous circRNA loaded into the transfer vehicle (e.g., a lipid nanoparticle) may be translated in vivo to produce a functional protein or enzyme encoded by the exogenously administered circRNA (e.g., a protein or enzyme in which the subject is deficient). Accordingly, the compositions of the present invention exploit a subject's ability to translate exogenously- or recombinantly-prepared circRNA to produce an endogenously-translated protein or enzyme, and thereby produce (and where applicable excrete) a functional protein or enzyme. The expressed or translated proteins or enzymes may also be characterized by the in vivo inclusion of native post-translational modifications which may often be absent in recombinantly-prepared proteins or enzymes, thereby further reducing the immunogenicity of the translated protein or enzyme.

The administration of circRNA encoding a deficient protein or enzyme avoids the need to deliver the nucleic acids to specific organelles within a target cell. Rather, upon transfection of a target cell and delivery of the nucleic acids to the cytoplasm of the target cell, the circRNA contents of a transfer vehicle may be translated and a functional protein or enzyme expressed.

In some embodiments, a circular RNA comprises one or more miRNA binding sites. In some embodiments, a circular RNA comprises one or more miRNA binding sites recognized by miRNA present in one or more non-target cells or non-target cell types (e.g., Kupffer cells or hepatic cells) and not present in one or more target cells or target cell types (e.g., hepatocytes or T cells). In some embodiments, a circular RNA comprises one or more miRNA binding sites recognized by miRNA present in an increased concentration in one or more non-target cells or non-target cell types (e.g., Kupffer cells or hepatic cells) compared to one or more target cells or target cell types (e.g., hepatocytes or T cells). miRNAs are thought to function by pairing with complementary sequences within RNA molecules, resulting in gene silencing.

In some embodiments, the compositions of the invention transfect or distribute to target cells on a discriminatory basis (i.e. do not transfect non-target cells). The compositions of the invention may also be prepared to preferentially target a variety of target cells, which include, but are not limited to, hepatocytes, epithelial cells, hematopoietic cells, epithelial cells, endothelial cells, lung cells, bone cells, stem cells, mesenchymal cells, neural cells (e.g., meninges, astrocytes, motor neurons, cells of the dorsal root ganglia and anterior horn motor neurons), photoreceptor cells (e.g., rods and cones), retinal pigmented epithelial cells, secretory cells, cardiac cells, adipocytes, vascular smooth muscle cells, cardiomyocytes, skeletal muscle cells, beta cells, pituitary cells, synovial lining cells, ovarian cells, testicular cells, fibroblasts, B cells, T cells, reticulocytes, leukocytes, granulocytes and tumor cells.

9. Pharmaceutical Compositions

In certain embodiments, provided herein are compositions (e.g., pharmaceutical compositions) comprising a therapeutic agent provided herein. In some embodiments, the therapeutic agent is a circular RNA polynucleotide provided herein. In some embodiments the therapeutic agent is a vector provided herein. In some embodiments, the therapeutic agent is a cell comprising a circular RNA or vector provided herein (e.g., a human cell, such as a human T cell).

In certain embodiments, the composition further comprises a pharmaceutically acceptable carrier. In some embodiments, the compositions provided herein comprise a therapeutic agent provided herein in combination with other pharmaceutically active agents or drugs, such as anti-inflammatory drugs or antibodies capable of targeting B cell antigens, e.g., anti-CD20 antibodies, e.g., rituximab.

With respect to pharmaceutical compositions, the pharmaceutically acceptable carrier can be any of those conventionally used and is limited only by chemico-physical considerations, such as solubility and lack of reactivity with the active agent(s), and by the route of administration. The pharmaceutically acceptable carriers described herein, for example, vehicles, adjuvants, excipients, and diluents, are well-known to those skilled in the art and are readily available to the public. It is preferred that the pharmaceutically acceptable carrier be one which is chemically inert to the therapeutic agent(s) and one which has no detrimental side effects or toxicity under the conditions of use.

The choice of carrier will be determined in part by the particular therapeutic agent, as well as by the particular method used to administer the therapeutic agent. Accordingly, there are a variety of suitable formulations of the pharmaceutical compositions provided herein.

In certain embodiments, the pharmaceutical composition comprises a preservative. In certain embodiments, suitable preservatives may include, for example, methylparaben, propylparaben, sodium benzoate, and benzalkonium chloride. Optionally, a mixture of two or more preservatives may be used. The preservative or mixtures thereof are typically present in an amount of about 0.0001% to about 2% by weight of the total composition.

In some embodiments, the pharmaceutical composition comprises a buffering agent. In some embodiments, suitable buffering agents may include, for example, citric acid, sodium citrate, phosphoric acid, potassium phosphate, and various other acids and salts. A mixture of two or more buffering agents optionally may be used. The buffering agent or mixtures thereof are typically present in an amount of about 0.001% to about 4% by weight of the total composition.

In some embodiments, the concentration of therapeutic agent in the pharmaceutical composition can vary, e.g., less than about 1%, or at least about 1%, 2%, 3%, 4%, 5%, 6%, 7%, 8%, 9% 10%, 15%, 20%, 25%, 30%, 35%, 40%, 45%, or about 50% or more by weight, and can be selected primarily by fluid volumes, and viscosities, in accordance with the particular mode of administration selected.

The following formulations for oral, aerosol, parenteral (e.g., subcutaneous, intravenous, intraarterial, intramuscular, intradermal, intraperitoneal, and intrathecal), and topical administration are merely exemplary and are in no way limiting. More than one route can be used to administer the therapeutic agents provided herein, and in certain instances, a particular route can provide a more immediate and more effective response than another route.

Formulations suitable for oral administration can comprise or consist of (a) liquid solutions, such as an effective amount of the therapeutic agent dissolved in diluents, such as water, saline, or orange juice; (b) capsules, sachets, tablets, lozenges, and troches, each containing a predetermined amount of the active ingredient, as solids or granules; (c) powders; (d) suspensions in an appropriate liquid; and (e) suitable emulsions. Liquid formulations may include diluents, such as water and alcohols, for example, ethanol, benzyl alcohol and the polyethylene alcohols, either with or without the addition of a pharmaceutically acceptable surfactant. Capsule forms can be of the ordinary hard or soft shelled gelatin type containing, for example, surfactants, lubricants, and inert fillers, such as lactose, sucrose, calcium phosphate, and corn starch. Tablet forms can include one or more of lactose, sucrose, mannitol, corn starch, potato starch, alginic acid, microcrystalline cellulose, acacia, gelatin, guar gum, colloidal silicon dioxide, croscarmellose sodium, talc, magnesium stearate, calcium stearate, zinc stearate, stearic acid, and other excipients, colorants, diluents, buffering agents, disintegrating agents, moistening agents, preservatives, flavoring agents, and other pharmacologically compatible excipients. Lozenge forms can comprise the therapeutic agent with a flavorant, usually sucrose, acacia or tragacanth. Pastilles can comprise the therapeutic agent with an inert base, such as gelatin and glycerin, or sucrose and acacia, emulsions, gels, and the like containing, in addition to, such excipients as are known in the art.

Formulations suitable for parenteral administration include aqueous and nonaqueous isotonic sterile injection solutions, which can contain antioxidants, buffers, bacteriostats, and solutes that render the formulation isotonic with the blood of the intended recipient, and aqueous and nonaqueous sterile suspensions that can include suspending agents, solubilizers, thickening agents, stabilizers, and preservatives. In some embodiments, the therapeutic agents provided herein can be administered in a physiologically acceptable diluent in a pharmaceutical carrier, such as a sterile liquid or mixture of liquids including water, saline, aqueous dextrose and related sugar solutions, an alcohol such as ethanol or hexadecyl alcohol, a glycol such as propylene glycol or polyethylene glycol, dimethylsulfoxide, glycerol, ketals such as 2,2-dimethyl-1,3-dioxolane-4-methanol, ethers, poly(ethyleneglycol) 400, oils, fatty acids, fatty acid esters or glycerides, or acetylated fatty acid glycerides with or without the addition of a pharmaceutically acceptable surfactant such as a soap or a detergent, suspending agent such as pectin, carbomers, methylcellulose, hydroxypropylmethylcellulose, or carboxymethylcellulose, or emulsifying agents and other pharmaceutical adjuvants.

Oils, which can be used in parenteral formulations in some embodiments, include petroleum, animal oils, vegetable oils, or synthetic oils. Specific examples of oils include peanut, soybean, sesame, cottonseed, corn, olive, petrolatum, and mineral oil. Suitable fatty acids for use in parenteral formulations include oleic acid, stearic acid, and isostearic acid. Ethyl oleate and isopropyl myristate are examples of suitable fatty acid esters.

Suitable soaps for use in certain embodiments of parenteral formulations include fatty alkali metal, ammonium, and triethanolamine salts, and suitable detergents include (a) cationic detergents such as, for example, dimethyl dialkyl ammonium halides. and alkyl pyridinium halides, (b) anionic detergents such as, for example, alkyl, aryl, and olefin sulfonates, alky, olefin, ether, and monoglyceride sulfates, and sulfosuccinates, (c) nonionic detergents such as, for example, fatty amine oxides, fatty acid alkanolamides, and polyoxyethylenepolypropylene copolymers, (d) amphoteric detergents such as, for example, alkyl-β-aminopropionates, and 2-alkyl-imidazoline quaternary ammonium salts, and (e) mixtures thereof.

In some embodiments, the parenteral formulations will contain, for example, from about 0.5% to about 25% by weight of the therapeutic agent in solution. Preservatives and buffers may be used. In order to minimize or eliminate irritation at the site of injection, such compositions may contain one or more nonionic surfactants having, for example, a hydrophile-lipophile balance (HLB) of from about 12 to about 17. The quantity of surfactant in such formulations will typically range, for example, from about 5% to about 15% by weight. Suitable surfactants include polyethylene glycol, sorbitan, fatty acid esters such as sorbitan monooleate, and high molecular weight adducts of ethylene oxide with a hydrophobic base formed by the condensation of propylene oxide with propylene glycol. The parenteral formulations can be presented in unit-dose or multi-dose sealed containers, such as ampoules or vials, and can be stored in a freeze-dried (lyophilized) condition requiring only the addition of a sterile liquid excipient, for example, water for injections, immediately prior to use. Extemporaneous injection solutions and suspensions can be prepared from sterile powders, granules, and tablets of the kind previously described.

In certain embodiments, injectable formulations are provided herein. The requirements for effective pharmaceutical carriers for injectable compositions are well-known to those of ordinary skill in the art (see, e.g., Pharmaceutics and Pharmacy Practice, J.B. Lippincott Company, Philadelphia, PA, Banker and Chalmers, eds., pages 238-250 (1982), and ASHP Handbook on Injectable Drugs, Toissel, 4th ed, pages 622-630 (1986)).

In some embodiments, topical formulations are provided herein. Topical formulations, including those that are useful for transdermal drug release, are suitable in the context of certain embodiments provided herein for application to skin. In some embodiments, the therapeutic agent alone or in combination with other suitable components, can be made into aerosol formulations to be administered via inhalation. These aerosol formulations can be placed into pressurized acceptable propellants, such as dichlorodifluoromethane, propane, nitrogen, and the like. They also may be formulated as pharmaceuticals for non-pressured preparations, such as in a nebulizer or an atomizer. Such spray formulations also may be used to spray mucosa.

In certain embodiments, the therapeutic agents provided herein can be formulated as inclusion complexes, such as cyclodextrin inclusion complexes, or liposomes. Liposomes can serve to target the therapeutic agents to a particular tissue. Liposomes also can be used to increase the half-life of the therapeutic agents. Many methods are available for preparing liposomes, as described in, for example, Szoka et al., Ann. Rev. Biophys. Bioeng., 9, 467 (1980) and U.S. Pat. Nos. 4,235,871, 4,501,728, 4,837,028, and 5,019,369.

In some embodiments, the therapeutic agents provided herein are formulated in time-released, delayed release, or sustained release delivery systems such that the delivery of the composition occurs prior to, and with sufficient time to, cause sensitization of the site to be treated. Such systems can avoid repeated administrations of the therapeutic agent, thereby increasing convenience to the subject and the physician, and may be particularly suitable for certain composition embodiments provided herein. In one embodiment, the compositions of the invention are formulated such that they are suitable for extended-release of the circRNA contained therein. Such extended-release compositions may be conveniently administered to a subject at extended dosing intervals. For example, in one embodiment, the compositions of the present invention are administered to a subject twice a day, daily or every other day. In an embodiment, the compositions of the present invention are administered to a subject twice a week, once a week, every ten days, every two weeks, every three weeks, every four weeks, once a month, every six weeks, every eight weeks, every three months, every four months, every six months, every eight months, every nine months or annually.

In some embodiments, a protein encoded by an inventive polynucleotide is produced by a target cell for sustained amounts of time. For example, the protein may be produced for more than one hour, more than four, more than six, more than 12, more than 24, more than 48 hours, or more than 72 hours after administration. In some embodiments the polypeptide is expressed at a peak level about six hours after administration. In some embodiments the expression of the polypeptide is sustained at least at a therapeutic level. In some embodiments, the polypeptide is expressed at least at a therapeutic level for more than one, more than four, more than six, more than 12, more than 24, more than 48, or more than 72 hours after administration. In some embodiments, the polypeptide is detectable at a therapeutic level in patient tissue (e.g., liver or lung). In some embodiments, the level of detectable polypeptide is from continuous expression from the circRNA composition over periods of time of more than one, more than four, more than six, more than 12, more than 24, more than 48, or more than 72 hours after administration.

In certain embodiments, a protein encoded by an inventive polynucleotide is produced at levels above normal physiological levels. The level of protein may be increased as compared to a control. In some embodiments, the control is the baseline physiological level of the polypeptide in a normal individual or in a population of normal individuals. In other embodiments, the control is the baseline physiological level of the polypeptide in an individual having a deficiency in the relevant protein or polypeptide or in a population of individuals having a deficiency in the relevant protein or polypeptide. In some embodiments, the control can be the normal level of the relevant protein or polypeptide in the individual to whom the composition is administered. In other embodiments, the control is the expression level of the polypeptide upon other therapeutic intervention, e.g., upon direct injection of the corresponding polypeptide, at one or more comparable time points.

In certain embodiments, the levels of a protein encoded by an inventive polynucleotide are detectable at 3 days, 4 days, 5 days, or 1 week or more after administration. Increased levels of protein may be observed in a tissue (e.g., liver or lung).

In some embodiments, the method yields a sustained circulation half-life of a protein encoded by an inventive polynucleotide. For example, the protein may be detected for hours or days longer than the half-life observed via subcutaneous injection of the protein or mRNA encoding the protein. In some embodiments, the half-life of the protein is 1 day, 2 days, 3 days, 4 days, 5 days, or 1 week or more.

Many types of release delivery systems are available and known to those of ordinary skill in the art. They include polymer based systems such as poly(lactide-glycolide), copolyoxalates, polycaprolactones, polyesteramides, polyorthoesters, polyhydroxybutyric acid, and polyanhydrides. Microcapsules of the foregoing polymers containing drugs are described in, for example, U.S. Pat. No. 5,075,109. Delivery systems also include non-polymer systems that are lipids including sterols such as cholesterol, cholesterol esters, and fatty acids or neutral fats such as mono-di- and tri-glycerides; hydrogel release systems; sylastic systems; peptide based systems: wax coatings; compressed tablets using conventional binders and excipients; partially fused implants; and the like. Specific examples include, but are not limited to: (a) erosional systems in which the active composition is contained in a form within a matrix such as those described in U.S. Pat. Nos. 4,452,775, 4,667,014, 4,748,034, and 5,239,660 and (b) diffusional systems in which an active component permeates at a controlled rate from a polymer such as described in U.S. Pat. Nos. 3,832,253 and 3,854,480. In addition, pump-based hardware delivery systems can be used, some of which are adapted for implantation.

In some embodiments, the therapeutic agent can be conjugated either directly or indirectly through a linking moiety to a targeting moiety. Methods for conjugating therapeutic agents to targeting moieties is known in the art. See, for instance, Wadwa et al., J, Drug Targeting 3:111 (1995) and U.S. Pat. No. 5,087,616.

In some embodiments, the therapeutic agents provided herein are formulated into a depot form, such that the manner in which the therapeutic agent is released into the body to which it is administered is controlled with respect to time and location within the body (see, for example, U.S. Pat. No. 4,450,150). Depot forms of therapeutic agents can be, for example, an implantable composition comprising the therapeutic agents and a porous or non-porous material, such as a polymer, wherein the therapeutic agents are encapsulated by or diffused throughout the material and/or degradation of the non-porous material. The depot is then implanted into the desired location within the body and the therapeutic agents are released from the implant at a predetermined rate.

10. Therapeutic Methods

A. Areas for Treatment & Relevant Diseases/Disorders

In certain aspects, provided herein is a method of treating and/or preventing a condition, e.g., an autoimmune disorder or cancer.

In certain embodiments, the therapeutic agents provided herein are co-administered with one or more additional therapeutic agents (e.g., in the same pharmaceutical composition or in separate pharmaceutical compositions). In some embodiments, the therapeutic agent provided herein can be administered first and the one or more additional therapeutic agents can be administered second, or vice versa. Alternatively, the therapeutic agent provided herein and the one or more additional therapeutic agents can be administered simultaneously.

In some embodiments, the subject is a mammal. In some embodiments, the mammal referred to herein can be any mammal, including, but not limited to, mammals of the order Rodentia, such as mice and hamsters, or mammals of the order Logomorpha, such as rabbits. The mammals may be from the order Carnivora, including Felines (cats) and Canines (dogs). The mammals may be from the order Artiodactyla, including Bovines (cows) and Swines (pigs), or of the order Perssodactyla, including Equines (horses). The mammals may be of the order Primates, Ceboids, or Simoids (monkeys) or of the order Anthropoids (humans and apes). Preferably, the mammal is a human.

EXAMPLES

Wesselhoeft et al., (2019) RNA Circularization Diminishes Immunogenicity and Can Extend Translation Duration In vivo. Molecular Cell. 74(3), 508-520 and Wesselhoeft et al., (2018) Engineering circular RNA for Potent and Stable Translation in Eukaryotic Cells. Nature Communications. 9, 2629 are incorporated by reference in their entirety.

The invention is further described in detail by reference to the following examples but are not intended to be limited to the following examples. These examples encompass any and all variations of the illustrations with the intention of providing those of ordinary skill in the art with complete disclosure and description of how to make and use the subject invention and are not intended to limit the scope of what is regarded as the invention.

Example 1

Example 1A: External Duplex Regions Allow for Circularization of Long Precursor RNA Using the Permuted Intron Exon (PIE) Circularization Strategy A 1.1 kb sequence containing a full-length encephalomyocarditis virus (EMCV) IRES, a *Gaussia* luciferase (GLuc) expression sequence, and two short exon fragments of the permuted intron-exon (PIE) construct were inserted between the 3' and 5' introns of the permuted group I catalytic intron in the thymidylate synthase (Td) gene of the T4 phage. Precursor RNA was synthesized by run-off transcription. Circularization was attempted by heating the precursor RNA in the presence of magnesium ions and GTP, but splicing products were not obtained.

Perfectly complementary 9 nucleotide and 19 nucleotide long duplex regions were designed and added at the 5' and 3' ends of the precursor RNA. Addition of these homology arms increased splicing efficiency from 0 to 16% for 9 nucleotide duplex regions and to 48% for 19 nucleotide duplex regions as assessed by disappearance of the precursor RNA band.

The splicing product was treated with RNase R. Sequencing across the putative splice junction of RNase R-treated splicing reactions revealed ligated exons, and digestion of the RNase R-treated splicing reaction with oligonucleotide-targeted RNase H produced a single band in contrast to two bands yielded by RNase H-digested linear precursor. This shows that circular RNA is a major product of the splicing reactions of precursor RNA containing the 9 or 19 nucleotide long external duplex regions Example 1B: Spacers that Conserve Secondary Structures of IRES and PIE Splice Sites Increase Circularization Efficiency A series of spacers was designed and inserted between the 3' PIE splice site and the IRES. These spacers were designed to either conserve or disrupt secondary structures within intron sequences in the IRES, 3' PIE splice site, and/or 5' splice site. The addition of spacer sequences designed to conserve secondary structures resulted in 87% splicing efficiency, while the addition of a disruptive spacer sequences resulted in no detectable splicing.

Example 2

Example 2A: Internal Duplex Regions in Addition to External Duplex Regions Create a Splicing Bubble and Allows for Translation of Several Expression Sequences Spacers were designed to be unstructured, non-homologous to the intron and IRES sequences, and to contain spacer-spacer duplex regions. These were inserted between the 5' exon and IRES and between the 3' exon and expression sequence in constructs containing external duplex regions, EMCV IRES, and expression sequences for *Gaussia* luciferase (total length: 1289 nt), Firefly luciferase (2384 nt), eGFP (1451 nt), human erythropoietin (1313 nt), and Cas9 endonuclease (4934 nt). Circularization of all 5 constructs was achieved. Circularization of constructs utilizing T4 phage and *Anabaena* introns were roughly equal. Circularization efficiency was higher for shorter sequences. To measure translation, each construct was transfected into HEK293 cells. *Gaussia* and Firefly luciferase transfected cells produced a robust response as measured by luminescence, human erythropoietin was detectable in the media of cells transfected with erythropoietin circRNA, and EGFP fluorescence was observed from cells transfected with EGFP circRNA. Co-transfection of Cas9 circRNA with sgRNA directed against GFP into cells constitutively expressing GFP resulted in ablated fluorescence in up to 97% of cells in comparison to an sgRNA-only control.

Example 2B: Use of CVB3 IRES Increases Protein Production

Constructs with internal and external duplex regions and differing IRES containing either *Gaussia* luciferase or Firefly luciferase expression sequences were made. Protein production was measured by luminescence in the supernatant of HEK293 cells 24 hours after transfection. The Coxsackievirus B3 (CVB3) IRES construct produced the most protein in both cases.

Example 2C: Use of polyA or polyAC Spacers Increases Protein Production

Thirty nucleotide long polyA or polyAC spacers were added between the IRES and splice junction in a construct with each IRES that produced protein in example 2B. *Gaussia* luciferase activity was measured by luminescence in the supernatant of HEK293 cells 24 hours after transfection. Both spacers improved expression in every construct over control constructs without spacers.

Example 3

HEK293 or HeLa Cells Transfected with Circular RNA Produce More Protein than Those Transfected with Comparable Unmodified or Modified Linear RNA.

HPLC-purified *Gaussia* luciferase-coding circRNA (CVB3-GLuc-pAC) was compared with a canonical unmodified 5' methylguanosine-capped and 3' polyA-tailed linear GLuc mRNA, and a commercially available nucleoside-modified (pseudouridine, 5-methylcytosine) linear GLuc mRNA (from Trilink). Luminescence was measured 24 h post-transfection, revealing that circRNA produced 811.2% more protein than the unmodified linear mRNA in HEK293 cells and 54.5% more protein than the modified mRNA. Similar results were obtained in HeLa cells and a comparison of optimized circRNA coding for human erythropoietin with linear mRNA modified with 5-methoxyuridine.

Luminescence data was collected over 6 days. In HEK293 cells, circRNA transfection resulted in a protein production half-life of 80 hours, in comparison with the 43 hours of unmodified linear mRNA and 45 hours of modified linear mRNA. In HeLa cells, circRNA transfection resulted in a protein production half-life of 116 hours, in comparison with the 44 hours of unmodified linear mRNA and 49 hours of modified linear mRNA. CircRNA produced substantially more protein than both the unmodified and modified linear mRNAs over its lifetime in both cell types.

Example 4

Example 4A: Purification of circRNA by RNase Digestion, HPLC Purification, and Phosphatase Treatment Decreases Immunogenicity. Completely Purified Circular RNA is Significantly Less Immunogenic than Unpurified or Partially Purified Circular RNA. Protein Expression Stability and Cell Viability are Dependent on Cell Type and Circular RNA Purity Human embryonic kidney 293 (HEK293) and human lung carcinoma A549 cells were transfected with:
  a. products of an unpurified GLuc circular RNA splicing reaction,
  b. products of RNase R digestion of the splicing reaction,
  c. products of RNase R digestion and HPLC purification of the splicing reaction, or
  d. products of RNase digestion, HPLC purification, and phosphatase treatment of the splicing reaction.

RNase R digestion of splicing reactions was insufficient to prevent cytokine release in A549 cells in comparison to untransfected controls.

The addition of HPLC purification was also insufficient to prevent cytokine release, although there was a significant reduction in interleukin-6 (IL-6) and a significant increase in interferon-α1 (IFNα1) compared to the unpurified splicing reaction.

The addition of a phosphatase treatment after HPLC purification and before RNase R digestion dramatically reduced the expression of all upregulated cytokines assessed in A549 cells. Secreted monocyte chemoattractant protein 1 (MCP1), IL-6, IFNα1, tumor necrosis factor α (TNFα), and IFNγ inducible protein-10 (IP-10) fell to undetectable or un-transfected baseline levels.

There was no substantial cytokine release in HEK293 cells. A549 cells had increased GLuc expression stability and cell viability when transfected with higher purity circular RNA. Completely purified circular RNA had a stability phenotype similar to that of transfected 293 cells.

Example 4B: Circular RNA does not Cause Significant Immunogenicity and is not a RIG-I Ligand A549 cells were transfected with:
  a. unpurified circular RNA,
  b. high molecular weight (linear and circular concatenations) RNA,
  c. circular (nicked) RNA,
  d. an early fraction of purified circular RNA (more overlap with nicked RNA peak),
  e. a late fraction of purified circular RNA (less overlap with nicked RNA peak),
  f. introns excised during circularization, or
  g. vehicle (i.e. untransfected control).

Precursor RNA was separately synthesized and purified in the form of the splice site deletion mutant (DS) due to difficulties in obtaining suitably pure linear precursor RNA from the splicing reaction. Cytokine release and cell viability was measured in each case.

Robust IL-6, RANTES, and IP-10 release was observed in response to most of the species present within the splicing reaction, as well as precursor RNA. Early circRNA fractions elicited cytokine responses comparable to other non-circRNA fractions, indicating that even relatively small quantities of linear RNA contaminants are able to induce a substantial cellular immune response in A549 cells. Late circRNA fractions elicited no cytokine response in excess of that from untransfected controls. A549 cell viability 36 hours post-transfection was significantly greater for late circRNA fractions compared with all of the other fractions.

RIG-I and IFN-β1 transcript induction upon transfection of A549 cells with late circRNA HPLC fractions, precursor RNA or unpurified splicing reactions were analyzed. Induction of both RIG-I and IFN-β1 transcripts were weaker for late circRNA fractions than precursor RNA and unpurified splicing reactions. RNase R treatment of splicing reactions alone was not sufficient to ablate this effect. Addition of very small quantities of the RIG-I ligand 3p-hpRNA to circular RNA induced substantial RIG-I transcription. In HeLa cells, transfection of RNase R-digested splicing reactions induced RIG-I and IFN-β1, but purified circRNA did not. Overall, HeLa cells were less sensitive to contaminating RNA species than A549 cells.

A time course experiment monitoring RIG-I, IFN-β1, IL-6, and RANTES transcript induction within the first 8 hours after transfection of A549 cells with splicing reactions or fully purified circRNA did not reveal a transient response to circRNA. Purified circRNA similarly failed to induce pro-inflammatory transcripts in RAW264.7 murine macrophages.

A549 cells were transfected with purified circRNA containing an EMCV IRES and EGFP expression sequence. This failed to produce substantial induction of pro-inflammatory transcripts. These data demonstrate that non-circular components of the splicing reaction are responsible for the immunogenicity observed in previous studies and that circRNA is not a natural ligand for RIG-I.

Example 5

Circular RNA Avoids Detection by TLRs.

TLR 3, 7, and 8 reporter cell lines were transfected with multiple linear or circular RNA constructs and secreted embryonic alkaline phosphatase (SEAP) was measured.

Linearized RNA was constructed by deleting the intron and homology arm sequences. The linear RNA constructs were then treated with phosphatase (in the case of capped RNAs, after capping) and purified by HPLC.

None of the attempted transfections produced a response in TLR7 reporter cells. TLR3 and TLR8 reporter cells were activated by capped linearized RNA, polyadenylated linearized RNA, the nicked circRNA HPLC fraction, and the early circRNA fraction. The late circRNA fraction and m1ψ-mRNA did not provoke TLR-mediated response in any cell line.

In a second experiment, circRNA was linearized using two methods: treatment of circRNA with heat in the presence of magnesium ions and DNA oligonucleotide-guided RNase H digestion. Both methods yielded a majority of full-length linear RNA with small amounts of intact circRNA. TLR3, 7, and 8 reporter cells were transfected with circular RNA, circular RNA degraded by heat, or circular RNA degraded by RNase H, and SEAP secretion was measured 36 hours after transfection. TLR8 reporter cells secreted SEAP in response to both forms of degraded circular RNA, but did not produce a greater response to circular RNA transfection than mock transfection. No activation was observed in TLR3 and TLR7 reporter cells for degraded or intact conditions, despite the activation of TLR3 by in vitro transcribed linearized RNA.

Example 6

Unmodified Circular RNA Produces Increased Sustained In Vivo Protein Expression than Linear RNA.

Mice were injected and HEK293 cells were transfected with unmodified and m1ψ-modified human erythropoietin (hEpo) linear mRNAs and circRNAs. Equimolar transfection of m1ψ-mRNA and unmodified circRNA resulted in robust protein expression in HEK293 cells. hEpo linear mRNA and circRNA displayed similar relative protein expression patterns and cell viabilities in comparison to GLuc linear mRNA and circRNA upon equal weight transfection of HEK293 and A549 cells.

In mice, hEpo was detected in serum after the injection of hEpo circRNA or linear mRNA into visceral adipose. hEpo detected after the injection of unmodified circRNA decayed more slowly than that from unmodified or m1ψ-mRNA and was still present 42 hours post-injection. Serum hEpo rapidly declined upon the injection of unpurified circRNA splicing reactions or unmodified linear mRNA. Injection of unpurified splicing reactions produced a cytokine response detectable in serum that was not observed for the other RNAs, including purified circRNA.

Example 7

Circular RNA can be Effectively Delivered In Vivo or In Vitro Via Lipid Nanoparticles.

Purified circular RNA was formulated into lipid nanoparticles (LNPs) with the ionizable lipidoid cKK-E12 (Dong et al., 2014; Kauffman et al., 2015). The particles formed uniform multilamellar structures with an average size, polydispersity index, and encapsulation efficiency similar to that of particles containing commercially available control linear mRNA modified with 5moU.

Purified hEpo circRNA displayed greater expression than 5moU-mRNA when encapsulated in LNPs and added to HEK293 cells. Expression stability from LNP-RNA in HEK293 cells was similar to that of RNA delivered by transfection reagent, with the exception of a slight delay in decay for both 5moU-mRNA and circRNA. Both unmodified circRNA and 5moU-mRNA failed to activate RIG-I/IFN-β1 in vitro.

In mice, LNP-RNA was delivered by local injection into visceral adipose tissue or intravenous delivery to the liver. Serum hEpo expression from circRNA was lower but comparable with that from 5moU-mRNA 6 hours after delivery in both cases. Serum hEpo detected after adipose injection of unmodified LNP-circRNA decayed more slowly than that from LNP-5moU-mRNA, with a delay in expression decay present in serum that was similar to that noted in vitro, but serum hEpo after intravenous injection of LNP-circRNA or LNP-5moU-mRNA decayed at approximately the same rate. There was no increase in serum cytokines or local RIG-I, TNFα, or IL-6 transcript induction in any of these cases.

Example 8

Expression and Functional Stability by IRES in HEK293, HepG2, and 1C1C7 Cells.

Figure 1C:
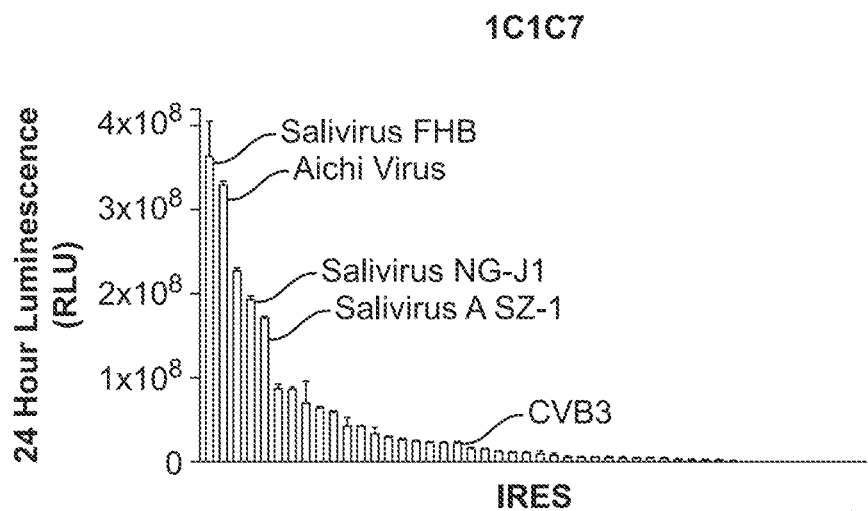
Figure 1D:
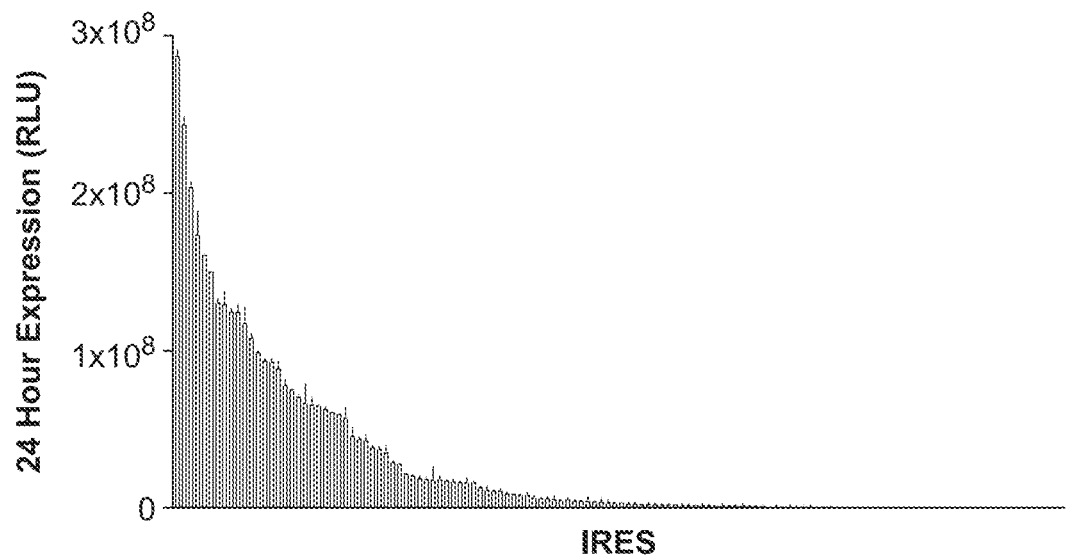
Figure 1E:
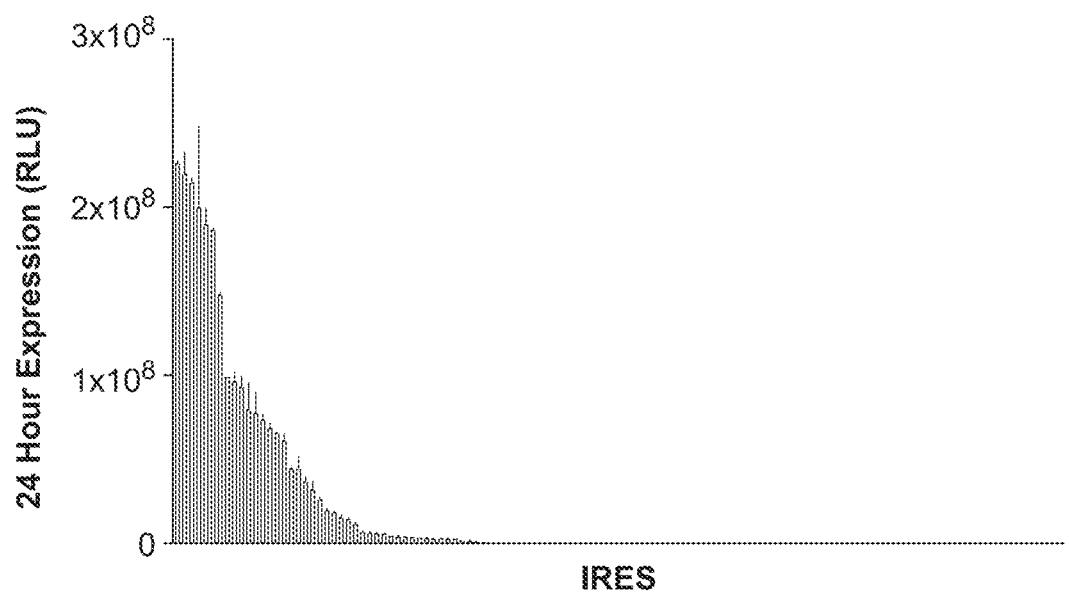

Constructs including anabaena intron/exon regions, a *Gaussia* luciferase expression sequence, and varying IRES were circularized. 100 ng of each circularization reaction was separately transfected into 20,000 HEK293 cells, HepG2 cells, and 1C1C7 cells using Lipofectamine MessengerMax. Luminescence in each supernatant was assessed after 24 hours as a measure of protein expression. In HEK293 cells, constructs including Crohivirus B, Salivirus FHB, Aichi Virus, Salivirus HG-J1, and Enterovirus J IRES produced the most luminescence at 24 hours (FIG. 1A). In HepG2 cells, constructs including Aichi Virus, Salivirus FHB, EMCV-Cf, and CVA3 IRES produced high luminescence at 24 hours (FIG. 1). In 1C1C7 cells, constructs including Salivirus FHB, Aichi Virus, Salivirus NG-J1, and Salivirus A SZ-1 IRES produced high luminescence at 24 hours (FIG. 1C).

Figure 2A:
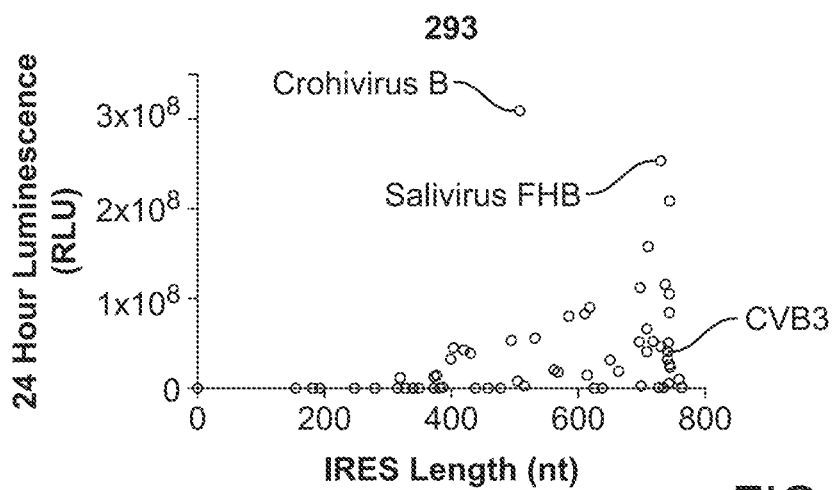
FIGS. 2A-2C depict luminescence in supernatants of HEK293 (FIG. 2A), HepG2 (FIG. 2B), or 1C1C7 (FIG. 2C) cells 24 hours after transfection with circular RNA comprising a *Gaussia* luciferase expression sequence and various IRES sequences having different lengths.
Figure 2B:
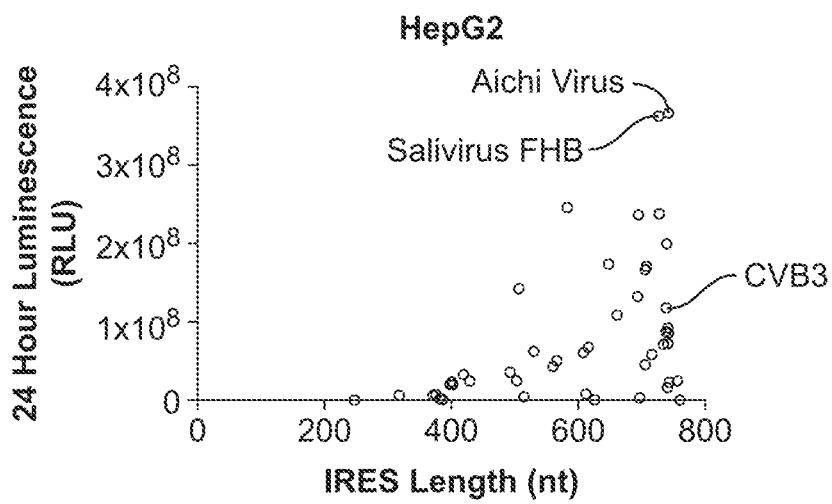
Figure 2C:
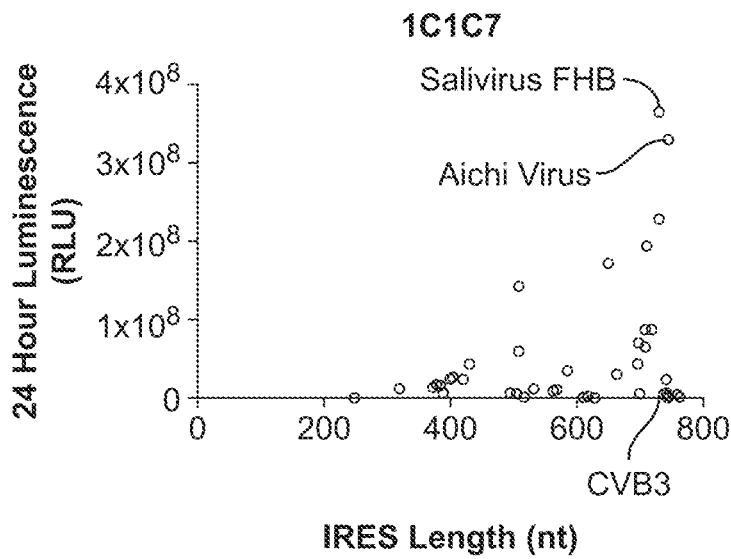

A trend of larger IRES producing greater luminescence at 24 hours was observed. Shorter total sequence length tends to increase circularization efficiency, so selecting a high expression and relatively short IRES may result in an improved construct. In HEK293 cells, a construct using the Crohivirus B IRES produced the highest luminescence, especially in comparison to other IRES of similar length (FIG. 2A). Expression from IRES constructs in HepG2 and 1C1C7 cells plotted against IRES size are in FIGS. 2B and 2C.

Figure 3A:
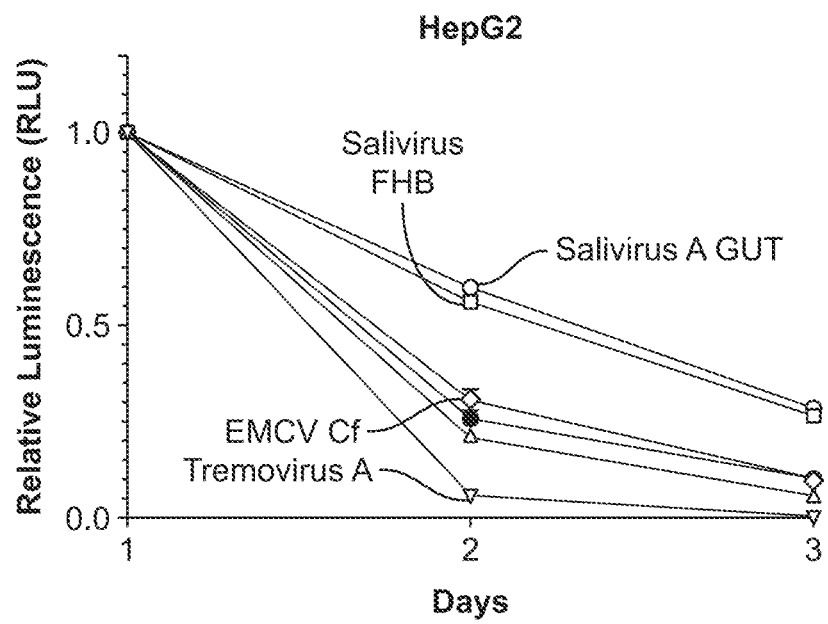
FIGS. 3A and 3B depict stability of select IRES constructs in HepG2 (FIG. 3A) or 1C1C7 (FIG. 3B) cells over 3 days as measured by luminescence.
Figure 3B:
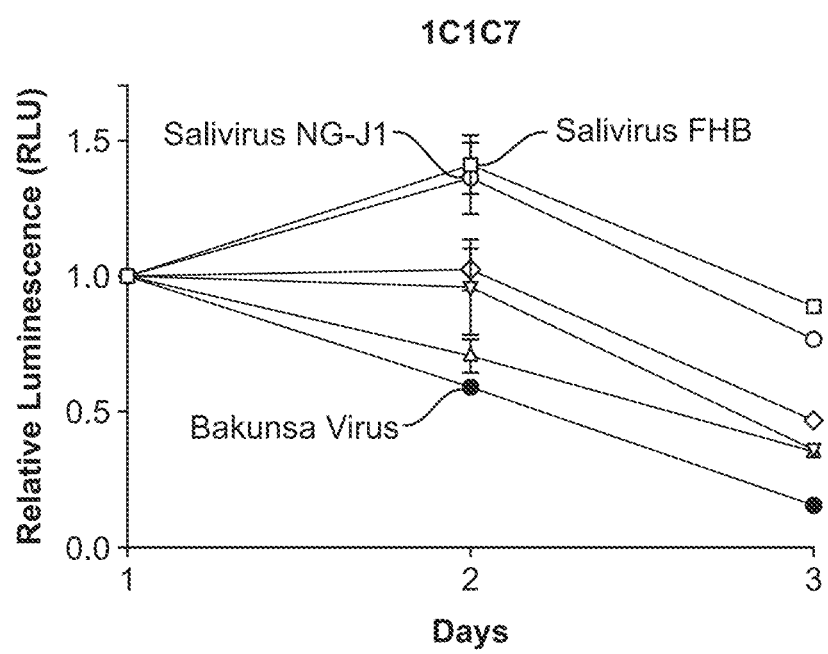

Functional stability of select IRES constructs in HepG2 and 1C1C7 cells were measured over 3 days. Luminescence from secreted *Gaussia* luciferase in supernatant was measured every 24 hours after transfection of 20,000 cells with 100 ng of each circularization reaction, followed by complete media replacement. Salivirus A GUT and Salivirus FHB exhibited the highest functional stability in HepG2 cells, and Salivirus N-J1 and Salivirus FHB produced the most stable expression in 1C1C7 cells (FIGS. 3A and 3B).

Example 9

Expression and Functional Stability by IRES in Jurkat Cells.

Figure 4A:
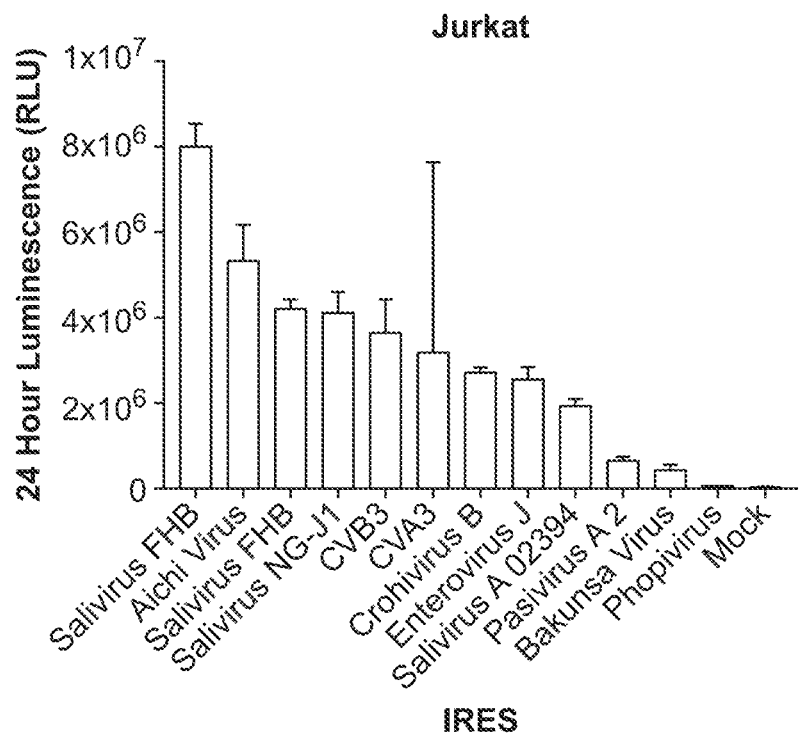
FIGS. 4A and 4B depict protein expression from select IRES constructs in Jurkat cells, as measured by luminescence from secreted *Gaussia* luciferase in cell supernatants.
Figure 4B:
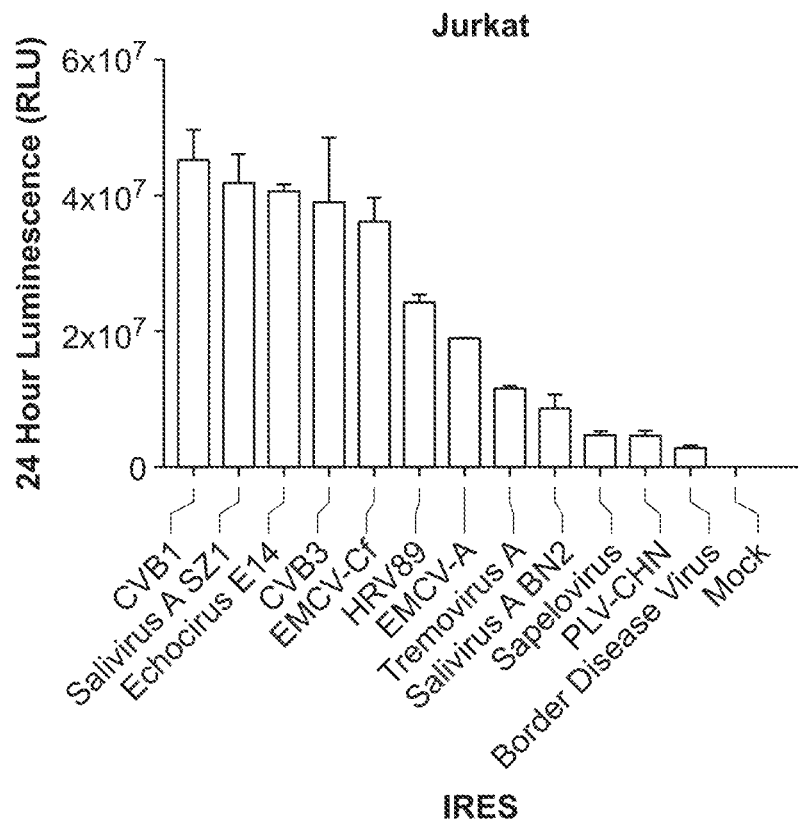

2 sets of constructs including anabaena intron/exon regions, a *Gaussia* luciferase expression sequence, and a subset of previously tested IRES were circularized. 60,000 Jurkat cells were electroporated with 1 µg of each circularization reaction. Luminescence from secreted *Gaussia* luciferase in supernatant was measured 24 hours after electroporation. A CVB3 IRES construct was included in both sets for comparison between sets and to previously defined IRES efficacy. CVB1 and Salivirus A SZ1 IRES constructs produced the most expression at 24 h. Data can be found in FIGS. 4A and 4B.

Figure 5A:
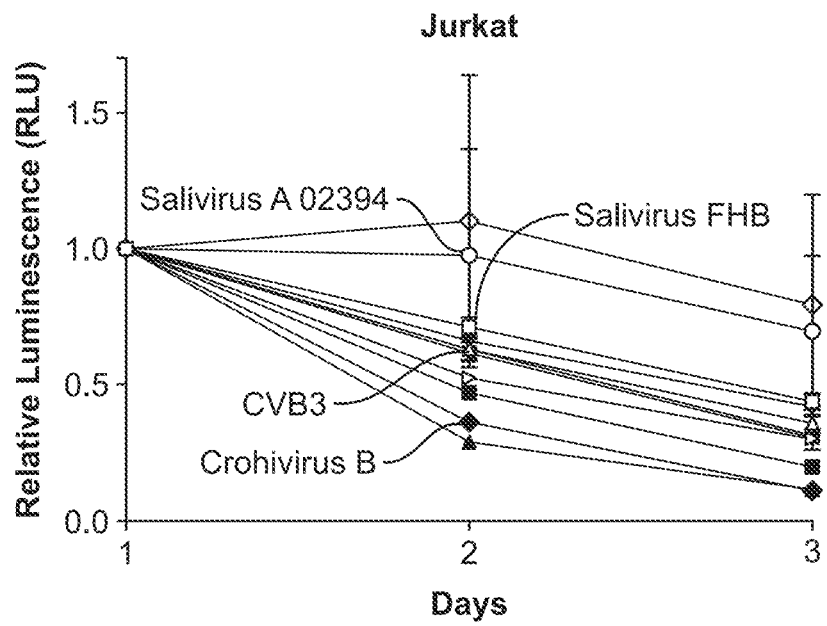
FIGS. 5A and 5B depict stability of select IRES constructs in Jurkat cells over 3 days as measured by luminescence.
Figure 5B:
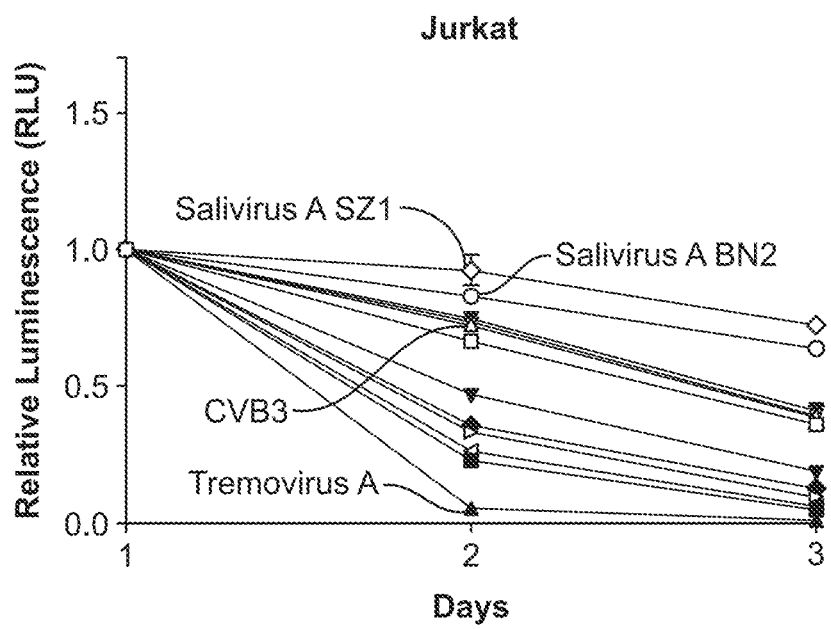

Functional stability of the TRES constructs in each round of electroporated Jurkat cells was measured over 3 days. Luminescence from secreted *Gaussia* luciferase in supernatant was measured every 24 hours after electroporation of 60,000 cells with 1 µg of each circularization reaction, followed by complete media replacement (FIGS. 5A and 5B).

Salivirus A SZ1 and Salivirus A BN2 IRES constructs had high functional stability compared to other constructs.

Example 10

Expression, Functional Stability, and Cytokine Release of Circular and Linear RNA in Jurkat Cells.

Figure 6A:
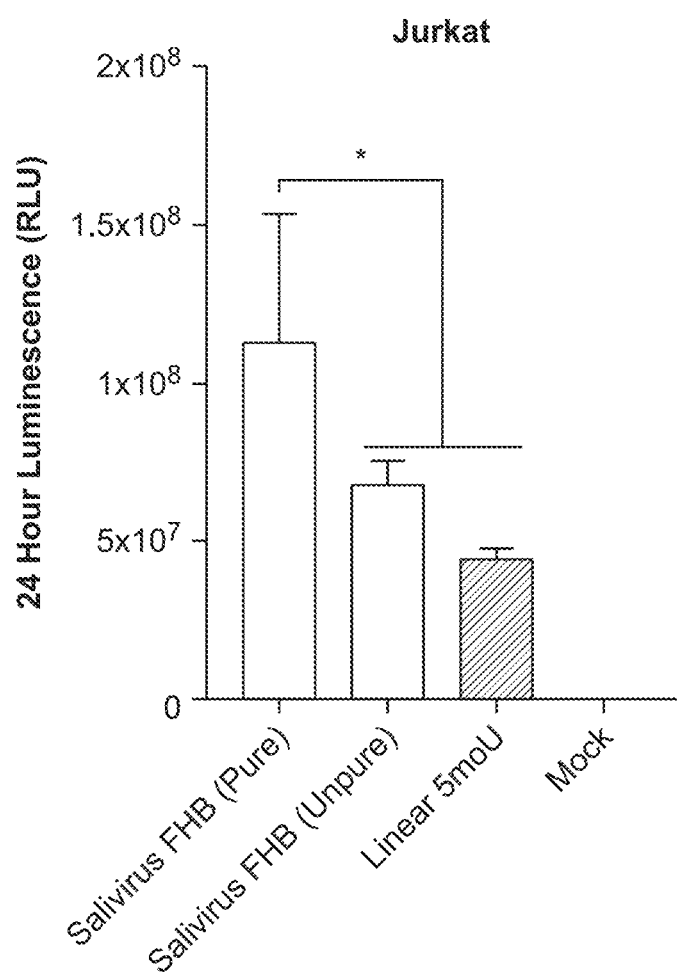
FIGS. 6A and 6B depict comparisons of 24 hour luminescence (FIG. 6A) or relative luminescence over 3 days (FIG. 6B) of modified linear, unpurified circular, or purified circular RNA encoding *Gaussia* luciferase.

A construct including *anabaena* intron/exon regions, a *Gaussia* luciferase expression sequence, and a Salivirus FHB IRES was circularized. mRNA including a *Gaussia* luciferase expression sequence and a ~150 nt polyA tail, and modified to replace 100% of uridine with 5-methoxy uridine (5moU) is commercially available and was purchased from Trilink. 5moU nucleotide modifications have been shown to improve mRNA stability and expression (Bioconjug Chem. 2016 Mar. 16; 27(3):849-53). Expression of modified mRNA, circularization reactions (unpure), and circRNA purified by size exclusion HPLC (pure) in Jurkat cells were measured and compared (FIG. 6A). Luminescence from secreted *Gaussia* luciferase in supernatant was measured 24 hours after electroporation of 60,000 cells with 1 µg of each RNA species.

Figure 6B:
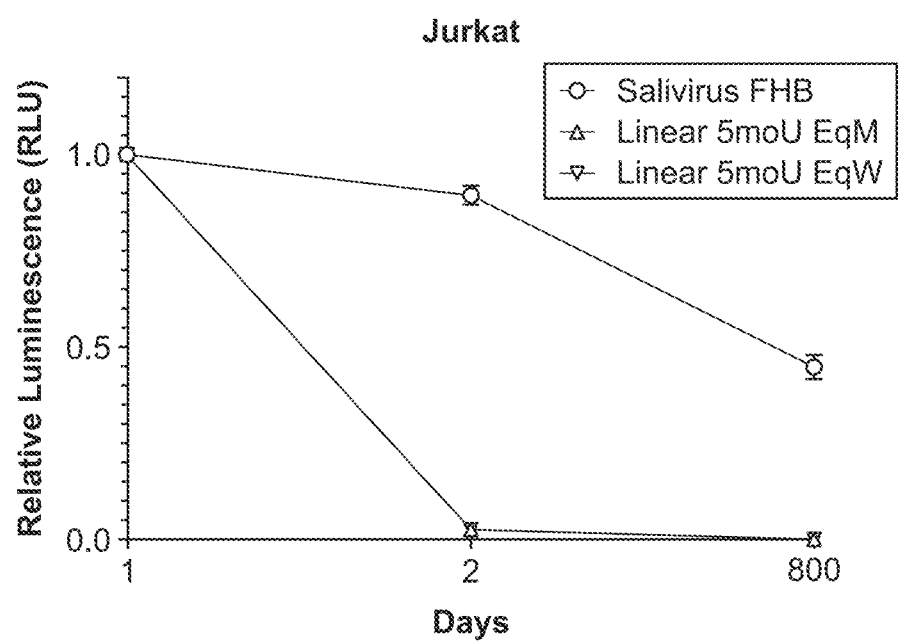

Luminescence from secreted *Gaussia* luciferase in supernatant was measured every 24 hours after electroporation of 60,000 cells with 1 µg of each RNA species, followed by complete media replacement. A comparison of functional stability data of modified mRNA and circRNA in Jurkat cells over 3 days is in FIG. 6B.

Figure 7A:
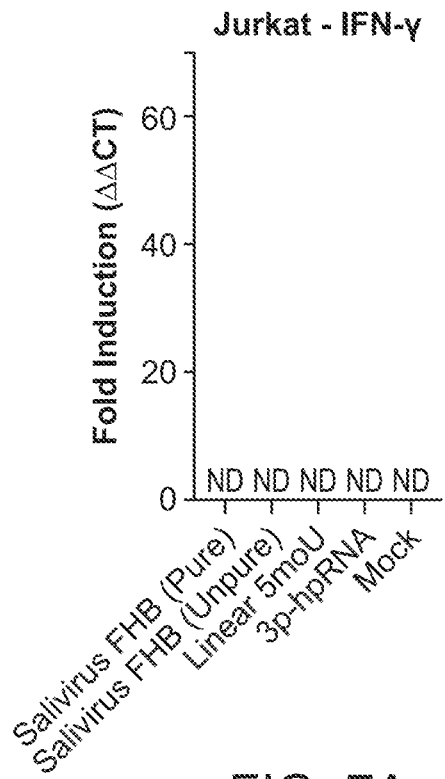
FIGS. 7A-7F depict transcript induction of IFNγ (FIG. 7A), IL-6 (FIG. 7B), IL-2 (FIG. 7C), RIG-I (FIG. 7D), IFN-β1 (FIG. 7E), and TNFα (FIG. 7F) after electroporation of Jurkat cells with modified linear, unpurified circular, or purified circular RNA.
Figure 7B:
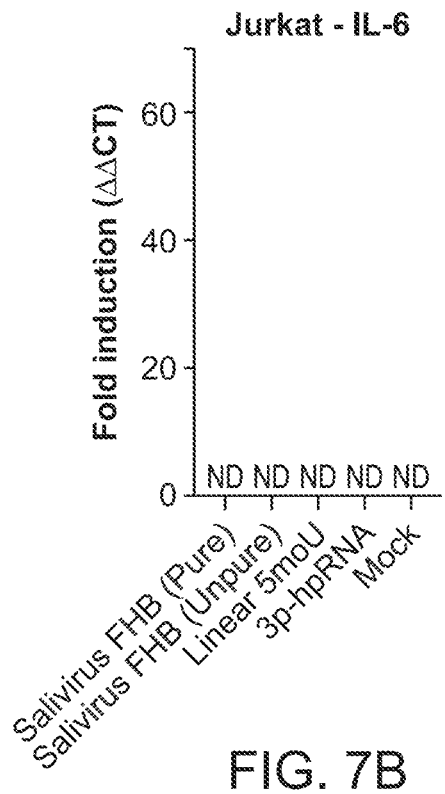
Figure 7C:
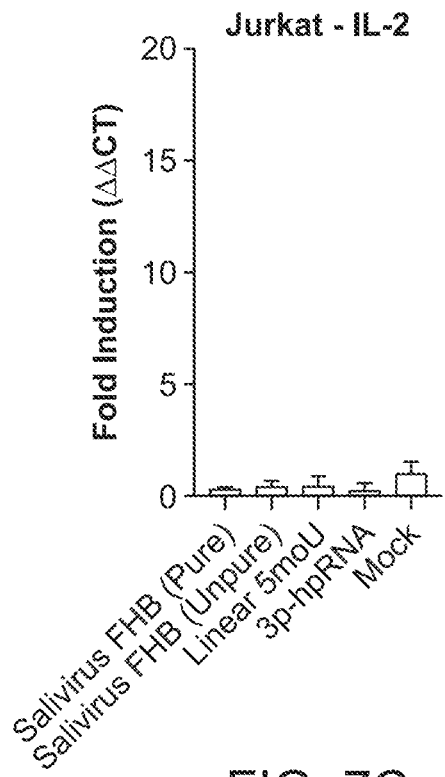
Figure 7D:
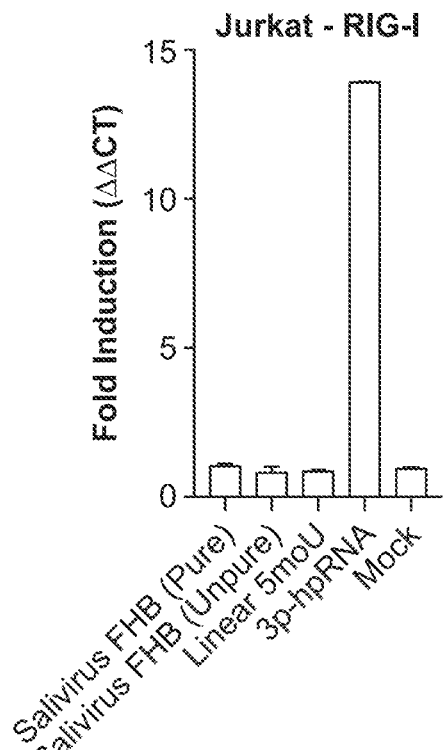
Figure 7E:
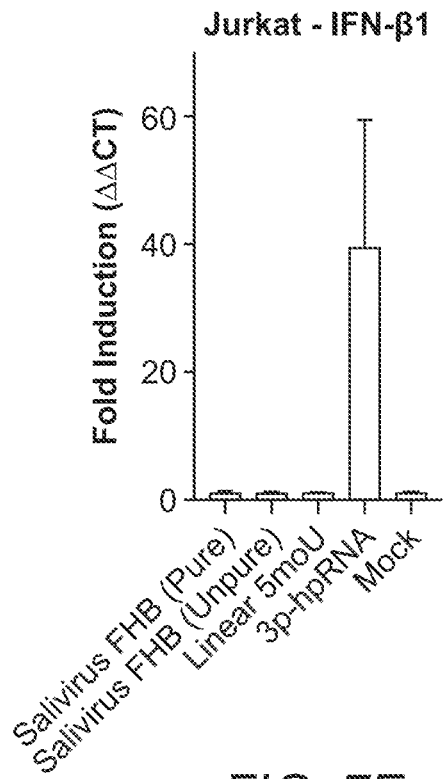
Figure 7F:
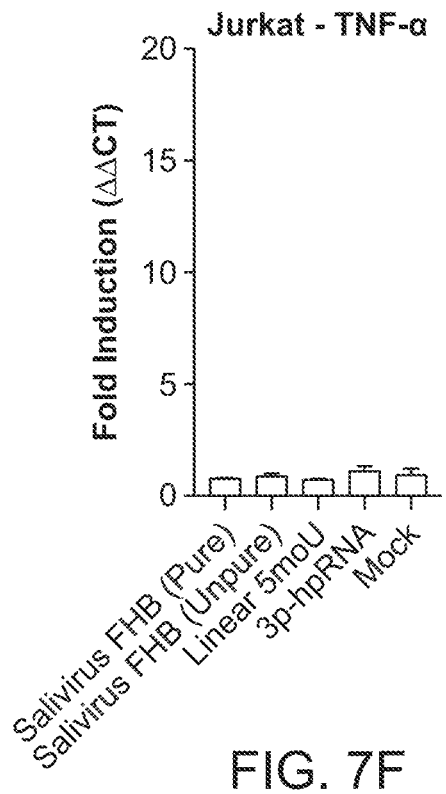

IFNγ (FIG. 7A), IL-6 (FIG. 7B), IL-2 (FIG. 7C), RIG-I (FIG. 7D), IFN-β1 (FIG. 7E), and TNFα (FIG. 7F) transcript induction was measured 18 hours after electroporation of 60,000 Jurkat cells with 1 µg of each RNA species described above and 3p-hpRNA (5' triphosphate hairpin RNA, which is a known RIG-I agonist).

Example 11

Expression of Circular and Linear RNA in Monocytes and Macrophages.

Figure 8A:
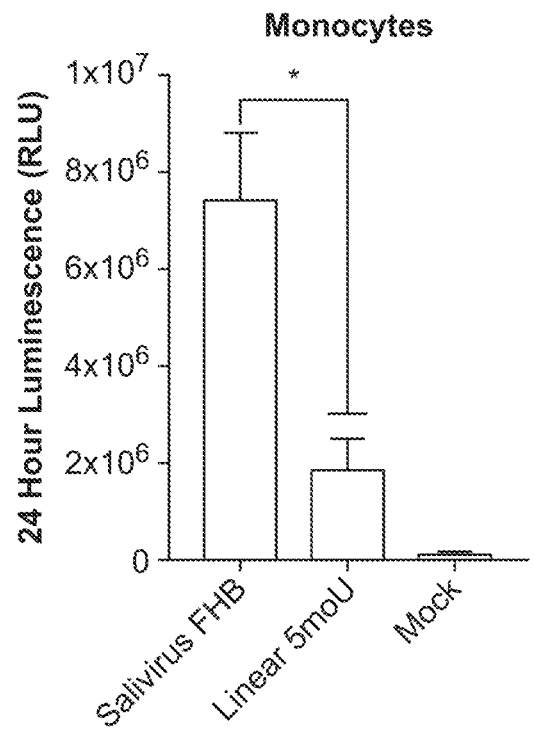
FIGS. 8A-8C depict a comparison of luminescence of circular RNA and modified linear RNA encoding *Gaussia* luciferase in human primary monocytes (FIG. 8A) and macrophages (FIG. 8B and FIG. 8C).
Figure 8B:
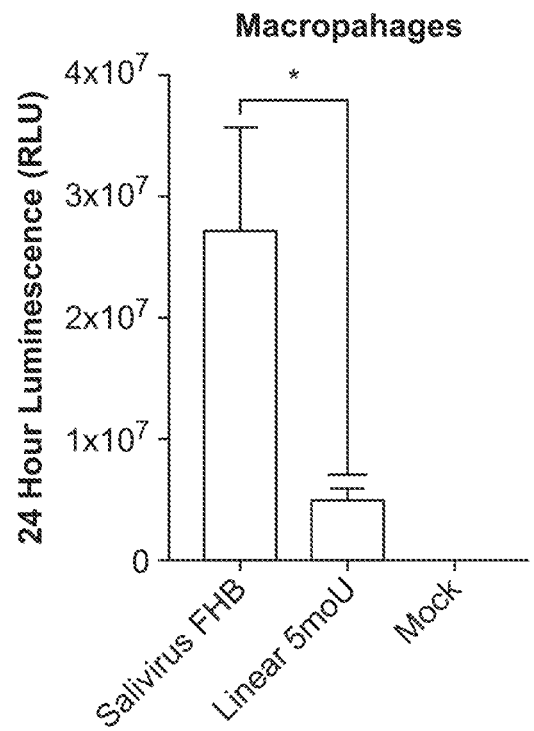
Figure 8C:
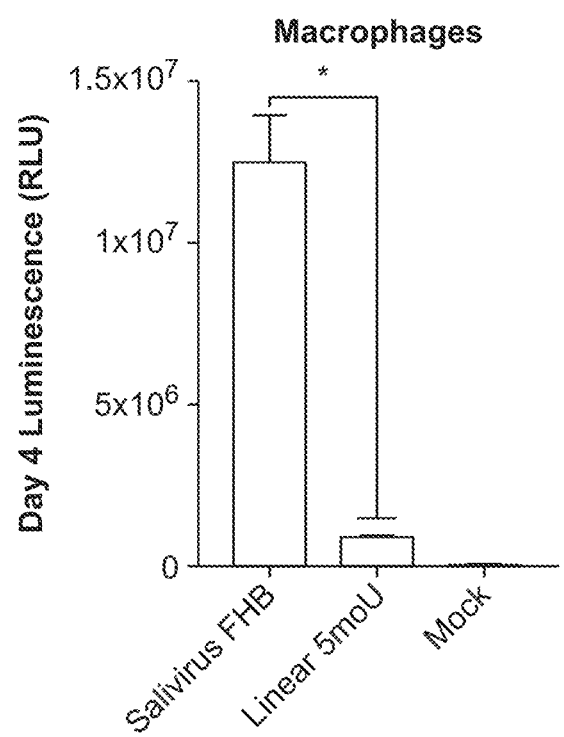

A construct including anabaena intron/exon regions, a *Gaussia* luciferase expression sequence, and a Salivirus FHB IRES was circularized. mRNA including a *Gaussia* luciferase expression sequence and a ~150 nt polyA tail, and modified to replace 100% of uridine with 5-methoxy uridine (5moU) was purchased from Trilink. Expression of circular and modified mRNA was measured in human primary monocytes (FIG. 8A) and human primary macrophages (FIG. 8B). Luminescence from secreted *Gaussia* luciferase in supernatant was measured 24 hours after electroporation of 60,000 cells with 1 µg of each RNA species. Luminescence was also measured 4 days after electroporation of human primary macrophages with media changes every 24 hours (FIG. 8C). The difference in luminescence was statistically significant in each case (p<0.05).

Example 12

Expression and Functional Stability by IRES in Primary T Cells.

Figure 9A:
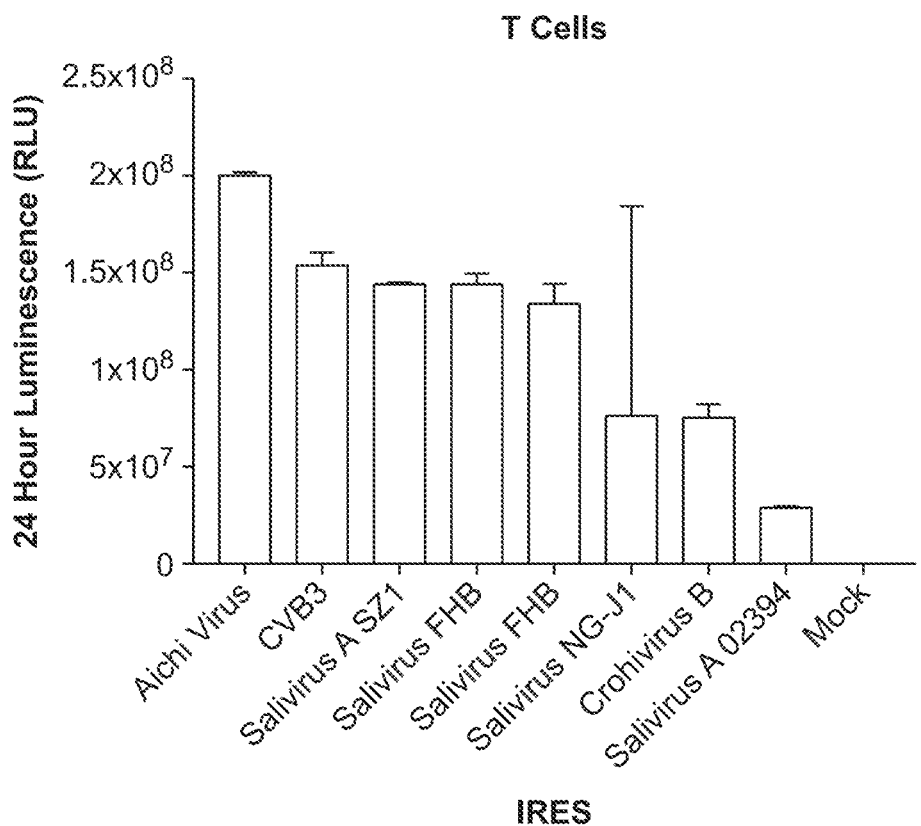
FIGS. 9A-9B depicts relative luminescence over 3 days (FIG. 9A) in supernatant of primary T cells after transduction with circular RNA comprising a *Gaussia* luciferase expression sequence and varying IRES sequences or 24 hour luminescence (FIG. 9B).

Constructs including anabaena intron/exon regions, a *Gaussia* luciferase expression sequence, and a subset of previously tested IRES were circularized and reaction products were purified by size exclusion HPLC. 150,000 primary human CD3+ T cells were electroporated with 1 µg of each circRNA. Luminescence from secreted *Gaussia* luciferase in supernatant was measured 24 hours after electroporation (FIG. 9A). Aichi Virus and CVB3 IRES constructs had the most expression at 24 hours.

Figure 9B:
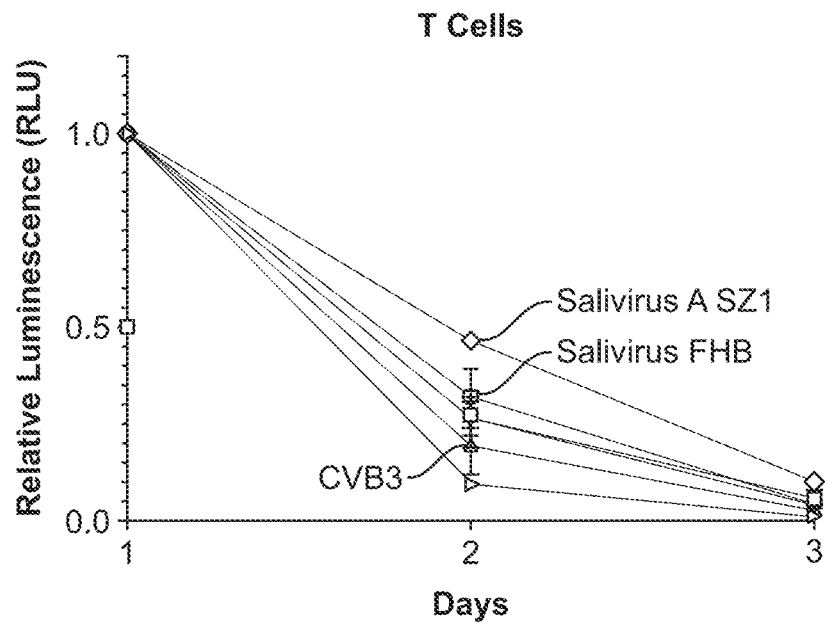

Luminescence was also measured every 24 hours after electroporation for 3 days in order to compare functional stability of each construct (FIG. 9B). The construct with a Salivirus A SZ1 IRES was the most stable.

Example 13

Expression and Functional Stability of Circular and Linear RNA in Primary T Cells and PBMCs.

Figure 10A:
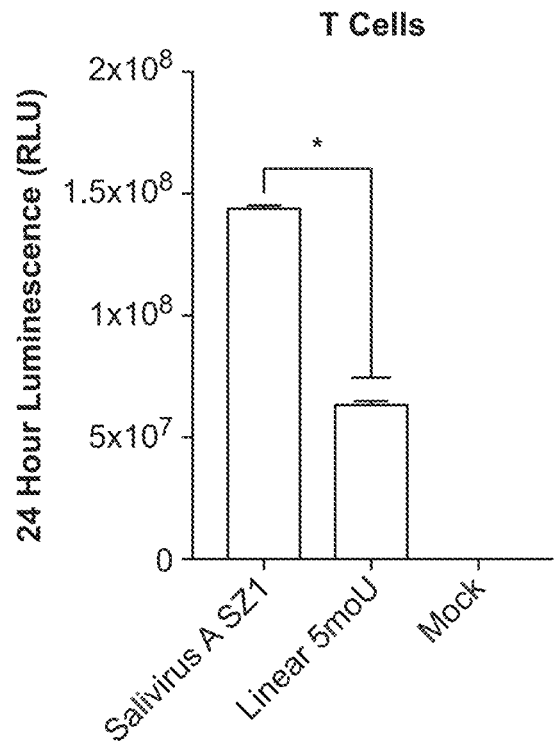
FIGS. 10A-10C depict 24 hour luminescence in supernatant of primary T cells (FIG. 10A) after transduction with circular RNA or modified linear RNA comprising a *Gaussia* luciferase expression sequence, or relative luminescence over 3 days (FIG. 10B), and 24 hour luminescence in PBMCs (FIG. 10C).

Constructs including anabaena intron/exon regions, a *Gaussia* luciferase expression sequence, and a Salivirus A SZ1 IRES or Salivirus FHB IRES were circularized. mRNA including a *Gaussia* luciferase expression sequence and a ~150 nt polyA tail, and modified to replace 100% of uridine with 5-methoxy uridine (5moU) and was purchased from Trilink. Expression of Salivirus A SZ1 IRES HPLC purified circular and modified mRNA was measured in human primary CD3+ T cells. Expression of Salivirus FHB HPLC purified circular, unpurified circular and modified mRNA was measured in human PBMCs. Luminescence from secreted *Gaussia* luciferase in supernatant was measured 24 hours after electroporation of 150,000 cells with 1 µg of each RNA species. Data for primary human T cells is in FIGS. 10A and 10B, and data for PBMCs is in FIG. 10C. The difference in expression between the purified circular RNA and unpurified circular RNA or linear RNA was significant in each case ($p<0.05$).

Figure 10B:
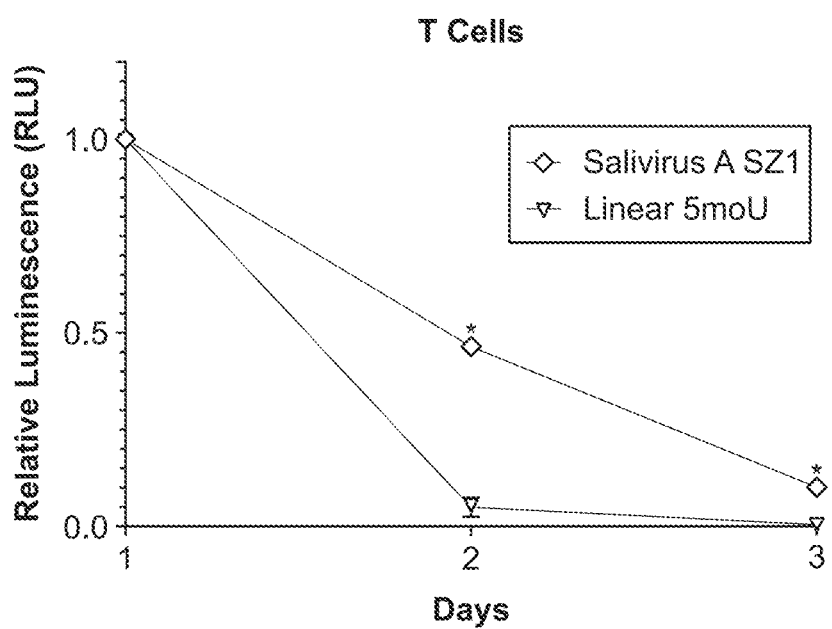
Figure 10C:
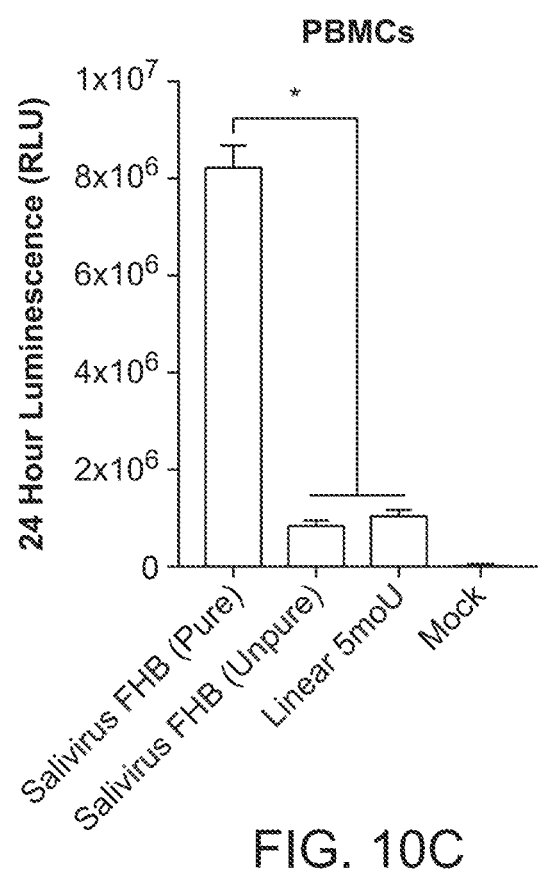

Luminescence from secreted *Gaussia* luciferase in primary T cell supernatant was measured every 24 hours after electroporation over 3 days in order to compare construct functional stability. Data is shown in FIG. 10B. The difference in relative luminescence from the day 1 measurement between purified circular RNA and linear RNA was significant at both day 2 and day 3 for primary T cells.

Example 14

Circularization Efficiency by Permutation Site in *Anabaena* Intron.

Figure 11A:
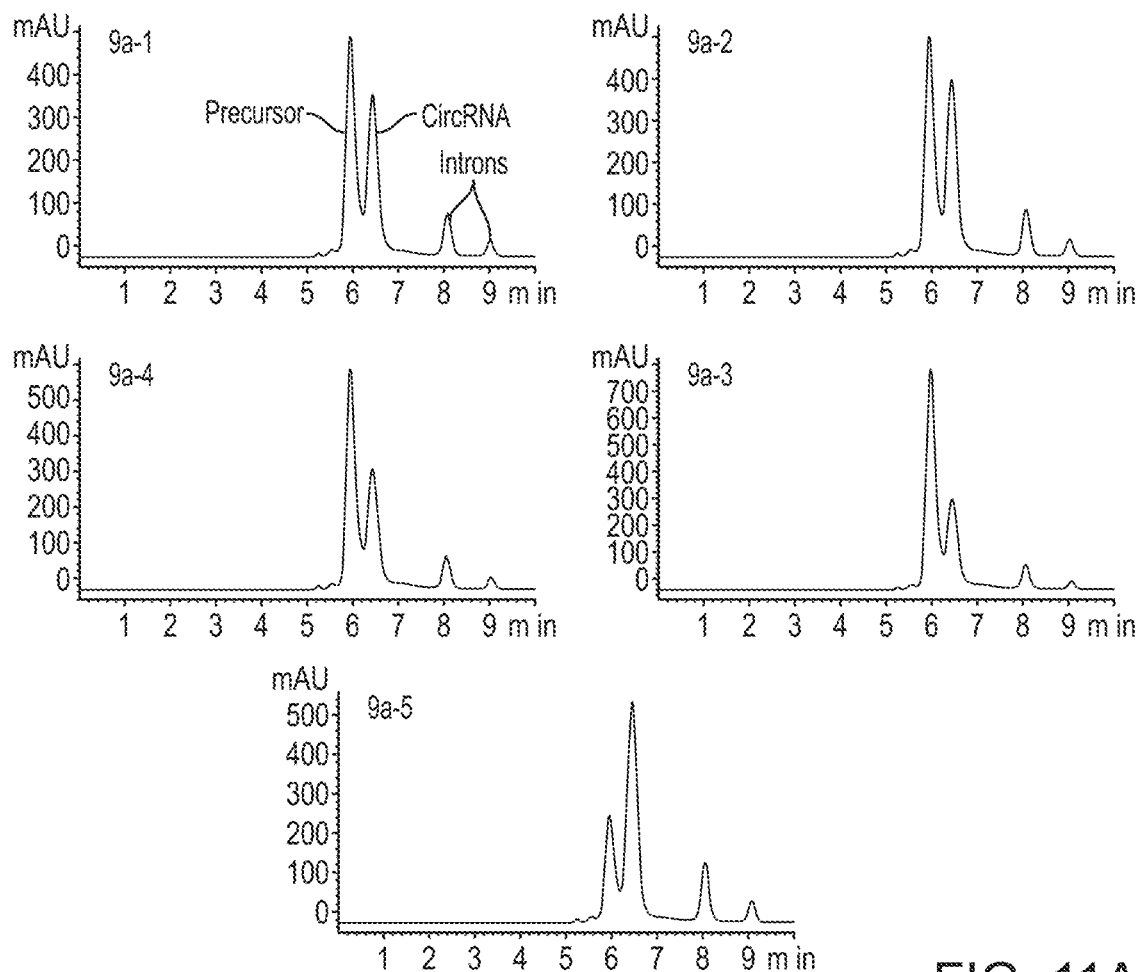
FIGS. 11A and 11B depict HPLC chromatograms (FIG. 11A) and circularization efficiencies (FIG. 11B) of RNA constructs having different permutation sites.

RNA constructs including a CVB3 IRES, a *Gaussia* luciferase expression sequence, anabaena intron/exon regions, spacers, internal duplex regions, and homology arms were produced. Circularization efficiency of constructs using the traditional anabaena intron permutation site and 5 consecutive permutations sites in P9 was measured by HPLC. HPLC chromatograms for the 5 consecutive permutation sites in P9 are shown in FIG. 11A.

Figure 11B:
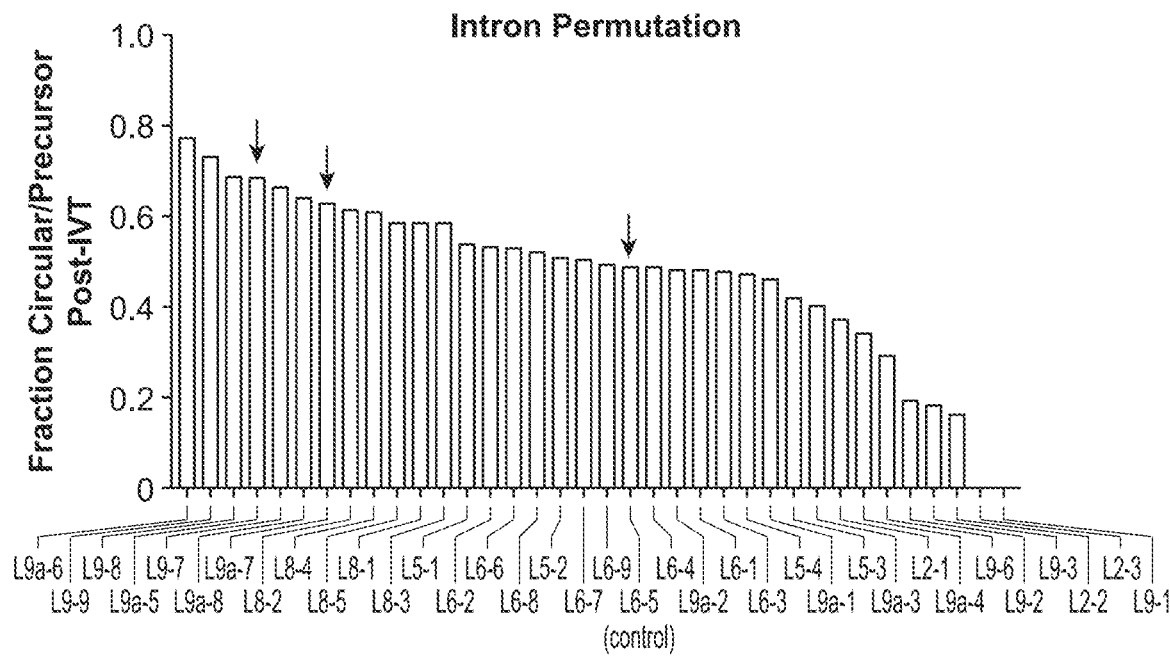

Circularization efficiency was measured at a variety of permutation sites. Circularization efficiency is defined as the area under the HPLC chromatogram curve for each of: circRNA/(circRNA+precursor RNA). Ranked quantification of circularization efficiency at each permutation site is in FIG. 11B. 3 permutation sites (indicated in FIG. 111B) were selected for further investigation.

Circular RNA in this example was circularized by in vitro transcription (IVT) then purified via spin column. Circularization efficiency for all constructs would likely be higher if the additional step of incubation with $Mg^{2+}$ and guanosine nucleotide were included; however, removing this step allowed for comparison between, and optimization of, circular RNA constructs. This level of optimization is especially useful for maintaining high circularization efficiency with large RNA constructs, such as those encoding chimeric antigen receptors.

Example 15

Circularization Efficiency of Alternative Introns.

Figure 12A:
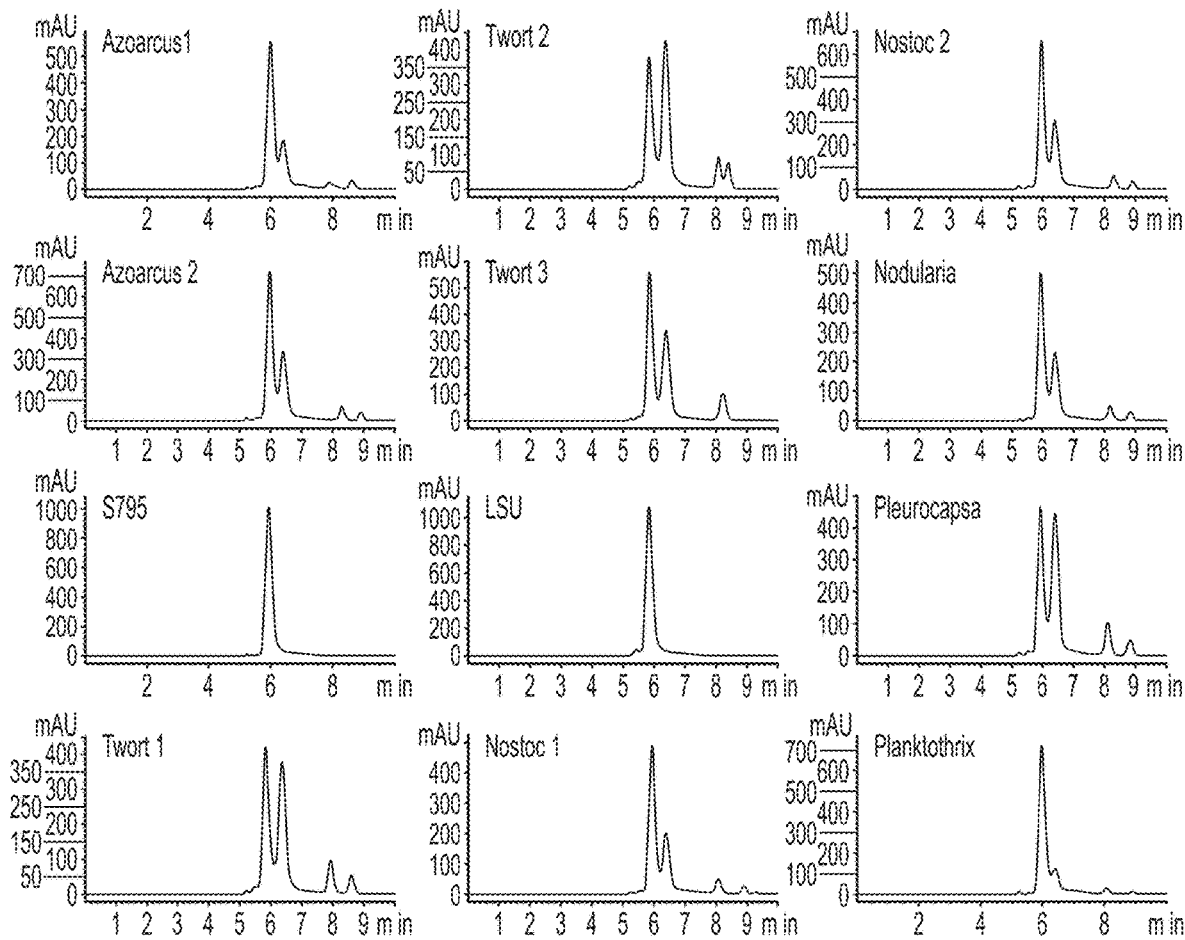
FIGS. 12A and 12B depict HPLC chromatograms (FIG. 12A) and circularization efficiencies (FIG. 12B) of RNA constructs having different introns and/or permutation sites.
Figure 12B:
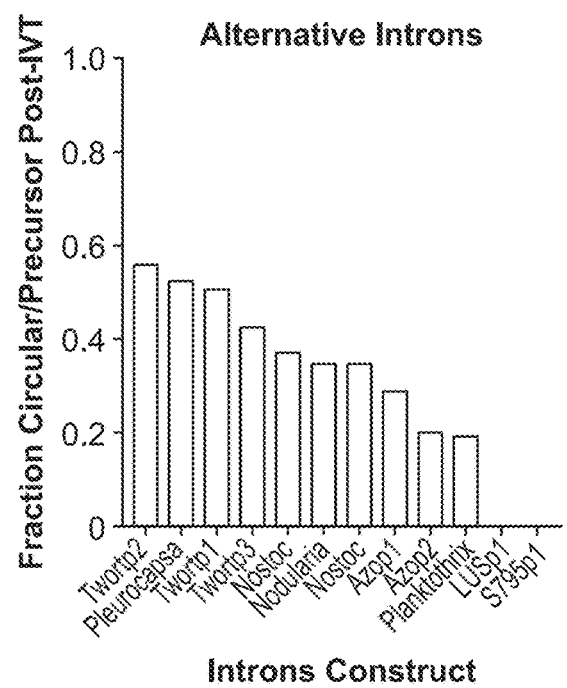

Precursor RNA containing a permuted group 1 intron of variable species origin or permutation site and several constant elements including: a CVB3 IRES, a *Gaussia* luciferase expression sequence, spacers, internal duplex regions, and homology arms were created. Circularization data can be found in FIG. 12. FIG. 12A shows chromatograms resolving precursor, CircRNA and introns. FIG. 12B provides ranked quantification of circularization efficiency, based on the chromatograms shown in FIG. 12A, as a function of intron construct.

Circular RNA in this example was circularized by in vitro transcription (IVT) then spin column purification. Circularization efficiency for all constructs would likely be higher if the additional step of incubation with $Mg^{2+}$ and guanosine nucleotide were included; however, removing this step allows for comparison between, and optimization of, circular RNA constructs. This level of optimization is especially useful for maintaining high circularization efficiency with large RNA constructs, such as those encoding chimeric antigen receptors.

Example 16

Circularization Efficiency by Homology Arm Presence or Length.

Figure 13A:
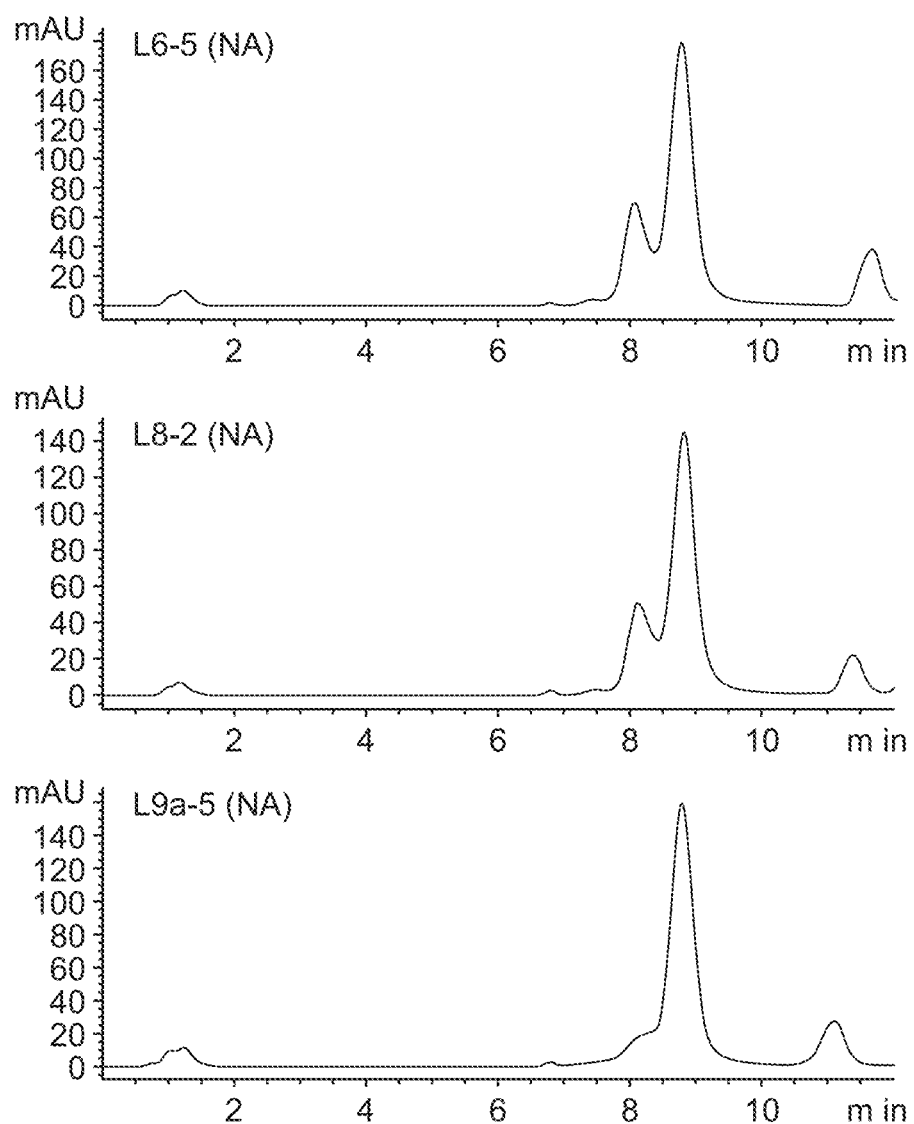
FIGS. 13A and 13B depict HPLC chromatograms (FIG. 13A) and circularization efficiencies (FIG. 13B) of 3 RNA constructs with or without homology arms.
Figure 13B:
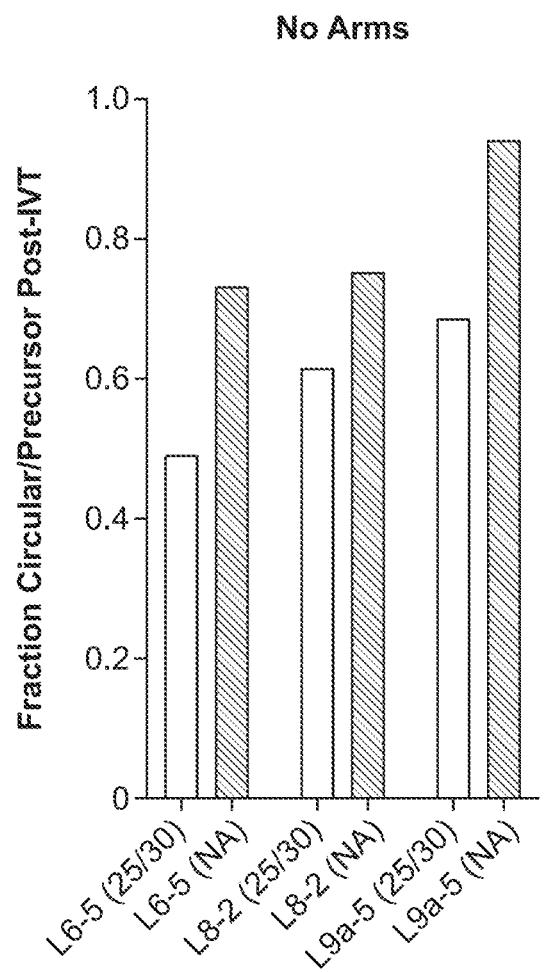

RNA constructs including a CVB3 IRES, a *Gaussia* luciferase expression sequence, anabaena intron/exon regions, spacers, and internal duplex regions were produced. Constructs representing 3 anabaena intron permutation sites were tested with 30 nt, 25% GC homology arms or without homology arms ("NA"). These constructs were allowed to circularize without the step of incubation with $Mg^{2+}$. Circularization efficiency was measured and compared. Data can be found in FIG. 13. Circularization efficiency was higher for each construct lacking homology arms. FIG. 13A provides ranked quantification of circularization efficiency; FIG. 13B provides chromatograms resolving precursor, circRNA and introns.

Figure 14:
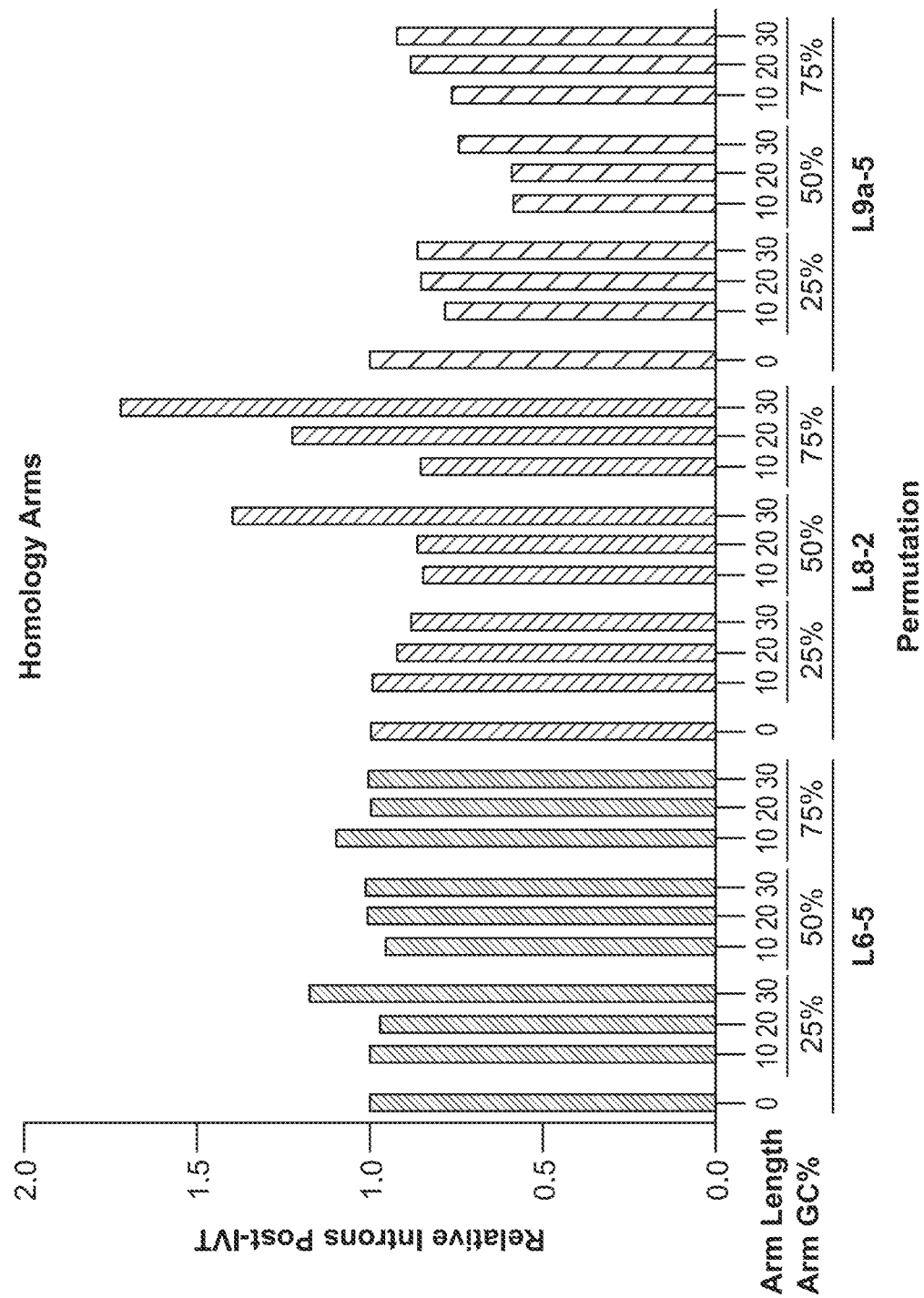
FIG. 14 depicts circularization efficiencies of 3 RNA constructs without homology arms or with homology arms having various lengths and GC content.

For each of the 3 permutation sites, constructs were created with 10 nt, 20 nt, and 30 nt arm length and 25%, 50%, and 75% GC. Splicing efficiency of these constructs was measured and compared to constructs without homology arms (FIG. 14). Splicing efficiency is defined as the proportion of free introns relative to the total RNA in the splicing reaction.

Figure 15A:
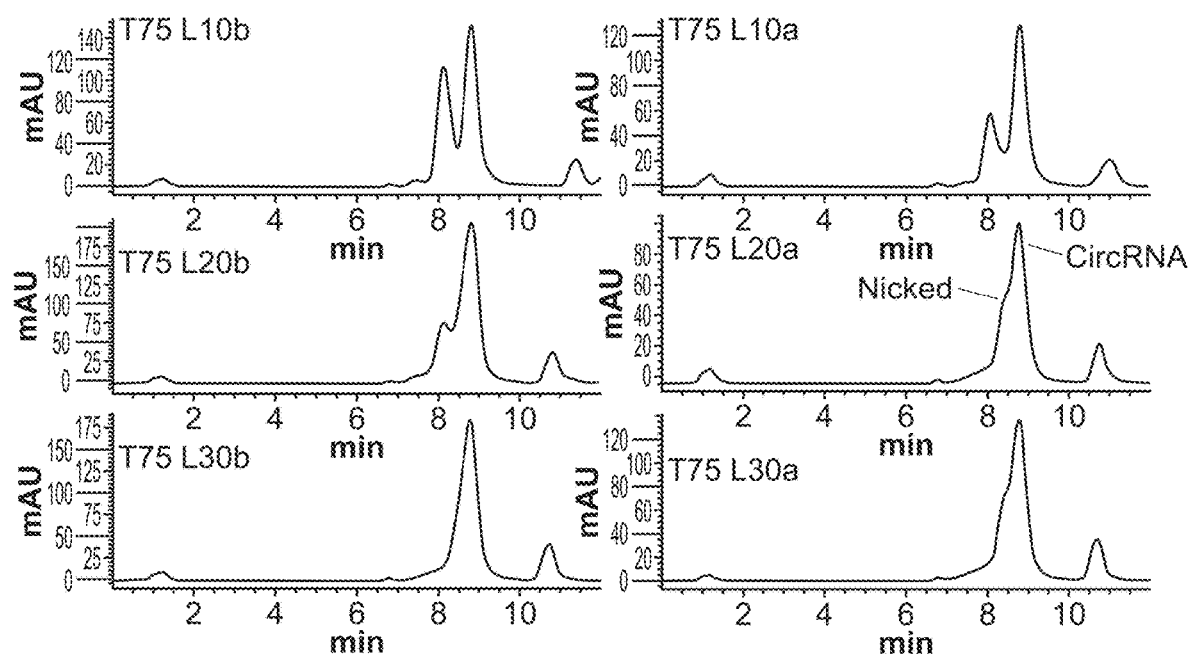
FIGS. 15A and 15B depict HPLC HPLC chromatograms showing the contribution of strong homology arms to improved splicing efficiency, the relationship between circularization efficiency and nicking in select constructs, and combinations of permutations sites and homology arms hypothesized to demonstrate improved circularization efficiency.
Figure 15B:
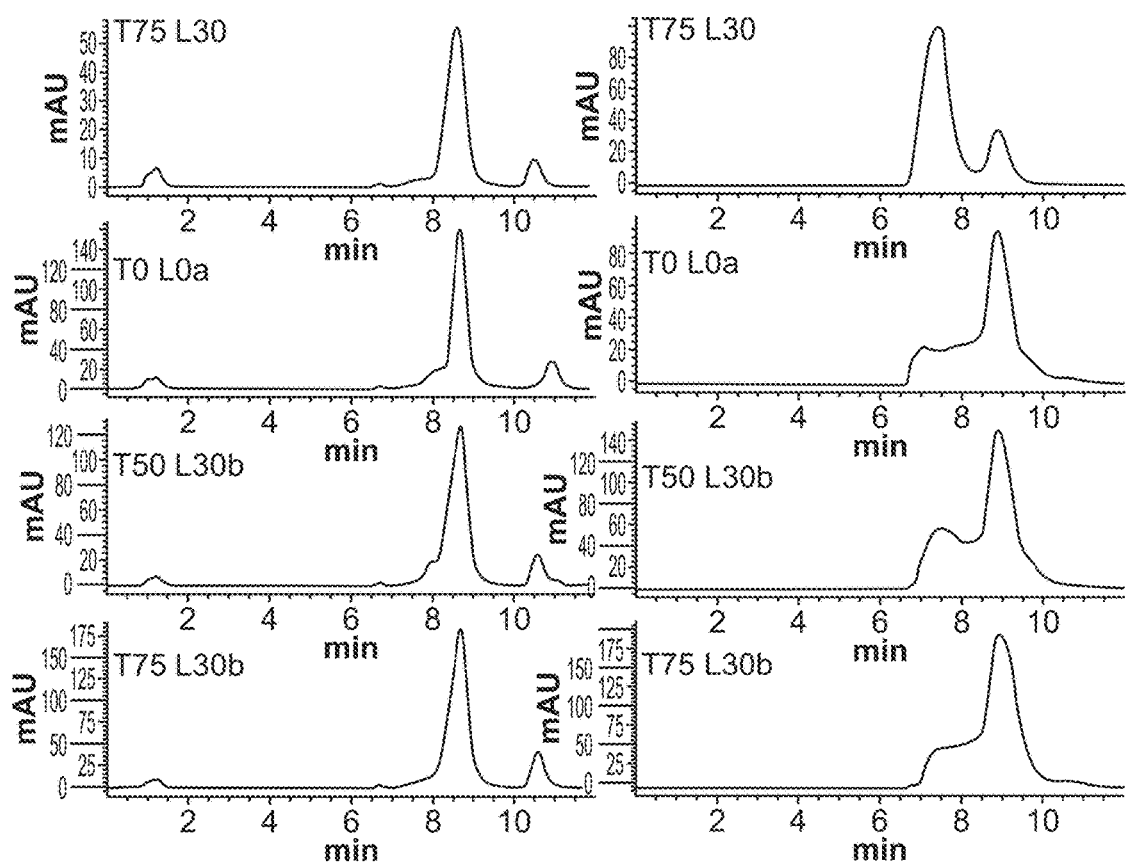

FIG. 15 A (left) contains HPLC chromatograms showing the contribution of strong homology arms to improved splicing efficiency. Top left: 75% GC content, 10 nt homology arms. Center left: 75% GC content, 20 nt homology arms. Bottom left: 75% GC content, 30 nt homology arms.

FIG. 15 A (right) shows HPLC chromatograms indicating increased splicing efficiency paired with increased nicking, appearing as a shoulder on the circRNA peak. Top right: 75% GC content, 10 nt homology arms. Center right: 75% GC content, 20 nt homology arms. Bottom right: 75% GC content, 30 nt homology arms.

FIG. 15 B (left) shows select combinations of permutation sites and homology arms hypothesized to demonstrate improved circularization efficiency.

FIG. 15 B (right) shows select combinations of permutation sites and homology arms hypothesized to demonstrate improved circularization efficiency, treated with *E. coli* polyA polymerase.

Circular RNA in this example was circularized by in vitro transcription (IVT) then spin-column purified. Circularization efficiency for all constructs would likely be higher if an additional $Mg^{2+}$ incubation step with guanosine nucleotide were included; however, removing this step allowed for comparison between, and optimization of, circular RNA constructs. This level of optimization is especially useful for maintaining high circularization efficiency with large RNA constructs, such as those encoding chimeric antigen receptors.

Example 17

Circular RNA Encoding Chimeric Antigen Receptors.

Figure 16:
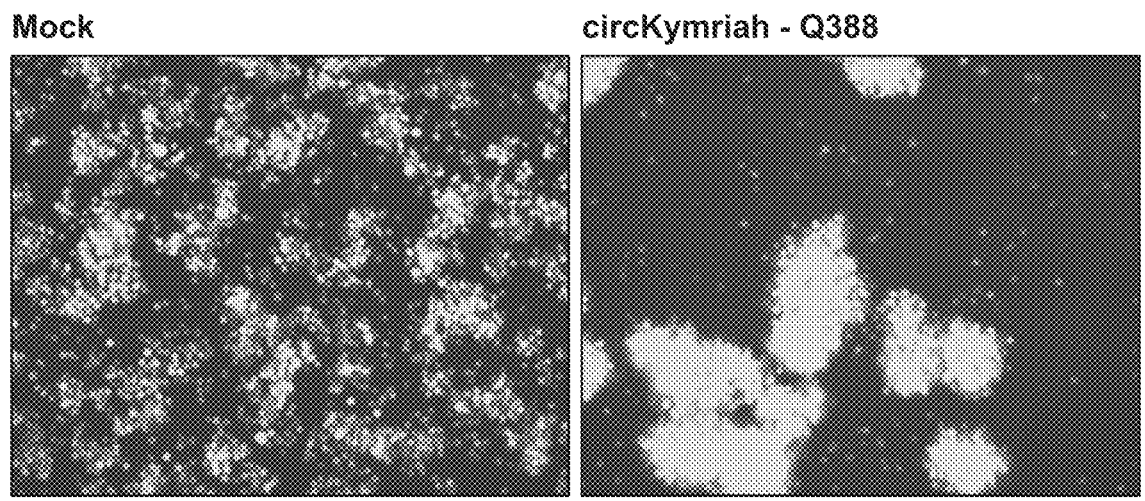
FIG. 16 shows fluorescent images of T cells mock electroporated (left) or electroporated with circular RNA encoding a CAR (right) in co-cultured with Raji cells expressing GFP and firefly luciferase.

Constructs including anabaena intron/exon regions, a Kymriah chimeric antigen receptor (CAR) expression sequence, and a CVB3 IRES were circularized. 100,000 human primary CD3+ T cells were electroporated with 500 ng of circRNA and co-cultured for 24 hours with Raji cells stably expressing GFP and firefly luciferase. Effector to target ratio (E:T ratio) 0.75:1. 100,000 human primary CD3+ T cells were mock electroporated and co-cultured as a control (FIG. 16).

Figure 17:
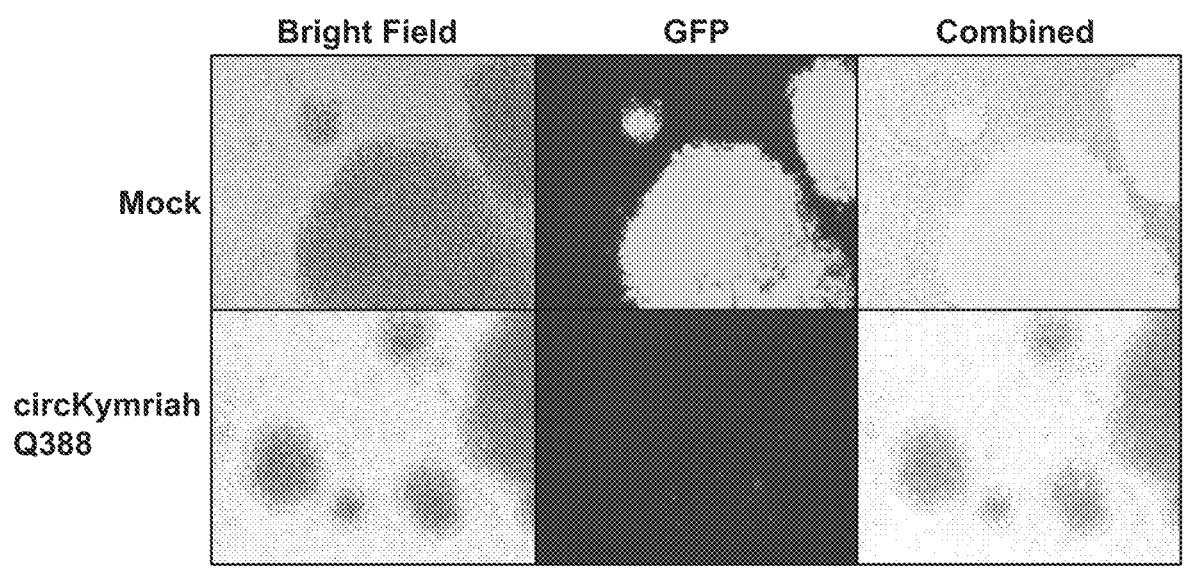
FIG. 17 shows bright field (left), fluorescent (center), and overlay (right) images of T cells mock electroporated (top) or electroporated with circular RNA encoding a CAR (bottom) and co-cultured with Raji cells expressing GFP and firefly luciferase.

Sets of 100,000 human primary CD3+ T cells were mock electroporated or electroporated with 1 μg of circRNA then co-cultured for 48 hours with Raji cells stably expressing GFP and firefly luciferase. E:T ratio 10:1 (FIG. 17).

Figure 18:
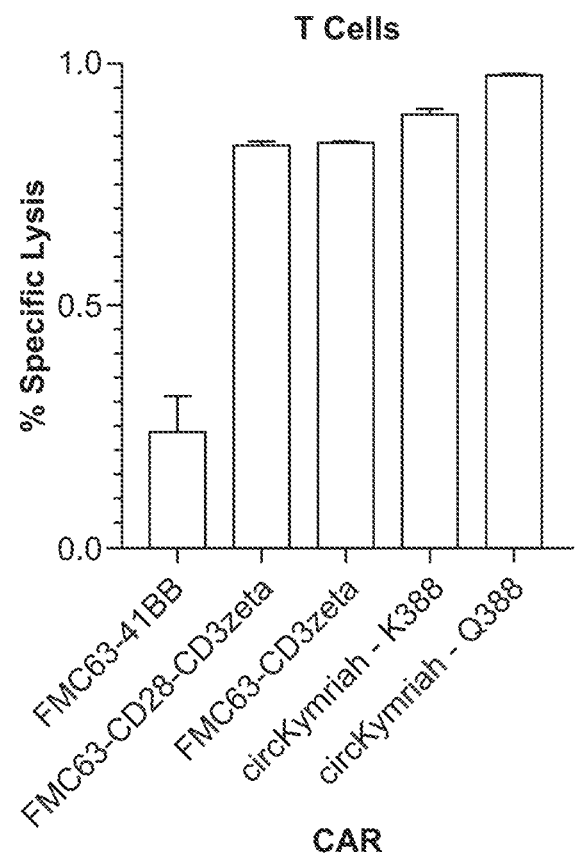
FIG. 18 depicts specific lysis of Raji target cells by T cells mock electroporated or electroporated with circular RNA encoding different CAR sequences.

Quantification of specific lysis of Raji target cells was determined by detection of firefly luminescence (FIG. 18). 100,000 human primary CD3+ T cells either mock electroporated or electroporated with circRNA encoding different CAR sequences were co-cultured for 48 hours with Raji cells stably expressing GFP and firefly luciferase. % Specific lysis defined as 1-[CAR condition luminescence]/[mock condition luminescence]. E:T ratio 10:1.

Example 18

Expression and Functional Stability of Circular and Linear RNA in Jurkat Cells and Resting Human T Cells.

Figure 19A:
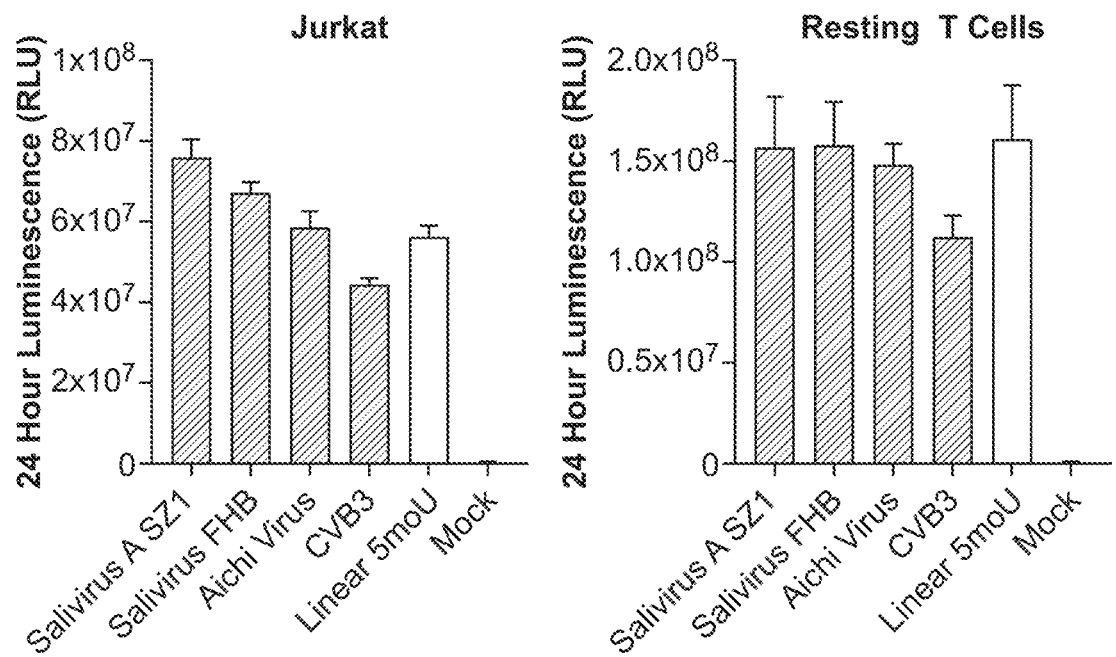
FIGS. 19A and 19B depict luminescence in supernatants of Jurkat cells (left) or resting primary human CD3+ T cells (right) 24 hours after transduction with linear or circular RNA comprising a *Gaussia* luciferase expression sequence and varying IRES sequences (FIG. 19A), and relative luminescence over 3 days (FIG. 19B).

Constructs including anabaena intron/exon regions, a *Gaussia* luciferase expression sequence, and a subset of previously tested IRES were circularized and reaction products were purified by size exclusion HPLC. 150,000 Jurkat cells were electroporated with 1 μg of circular RNA or 5moU-mRNA. Luminescence from secreted *Gaussia* luciferase in supernatant was measured 24 hours after electroporation (FIG. 19A left). 150,000 resting primary human CD3+ T cells (10 days post-stimulation) were electroporated with 1 μg of circular RNA or 5moU-mRNA. Luminescence from secreted *Gaussia* luciferase in supernatant was measured 24 hours after electroporation (FIG. 19A right).

Figure 19B:
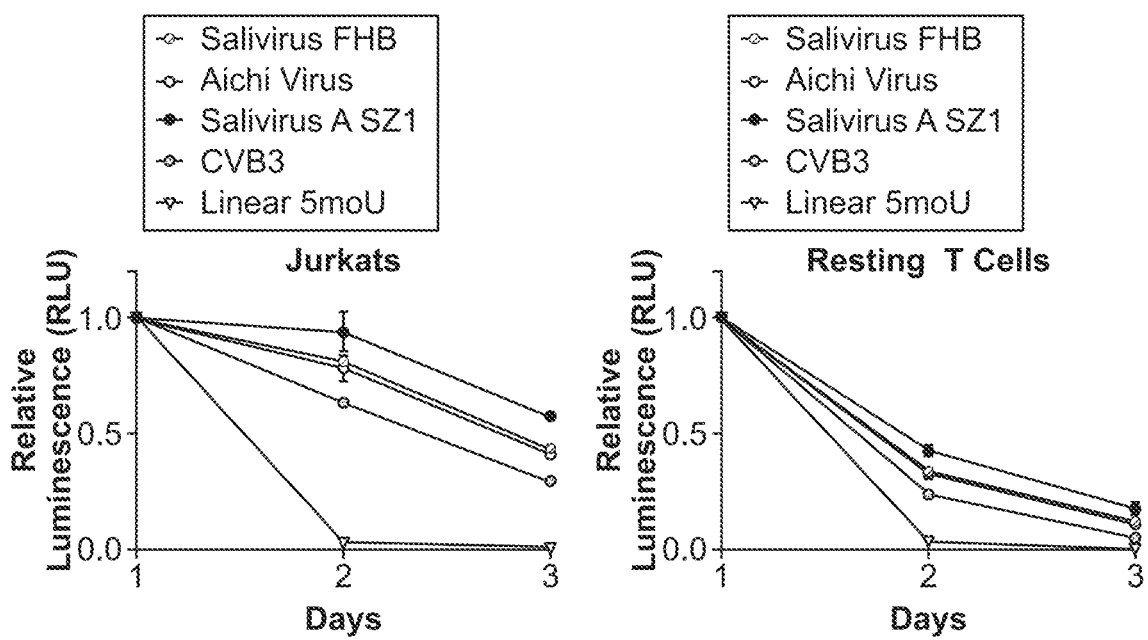

Luminescence from secreted *Gaussia* luciferase in supernatant was measured every 24 hours after electroporation, followed by complete media replacement. Functional stability data is shown in FIG. 19B. Circular RNA had more functional stability than linear RNA in each case, with a more pronounced difference in Jurkat cells.

Example 19

IFN-β1, RIG-I, IL-2, IL-6, IFNγ, and TNFα Transcript Induction of Cells Electroporated with Linear RNA or Varying Circular RNA Constructs.

Figure 20A:
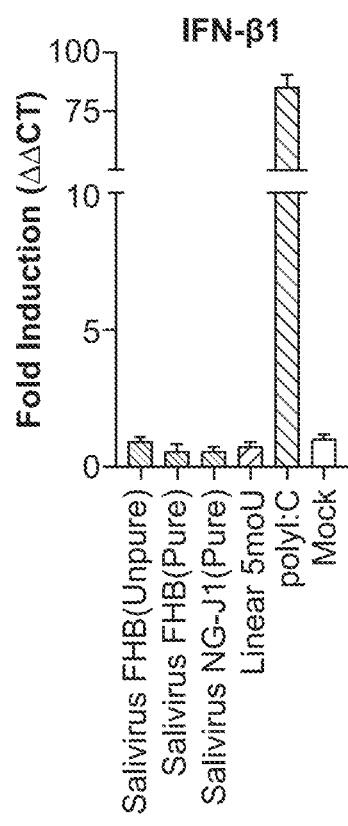
FIGS. 20A-20F depict transcript induction of IFN-β1 (FIG. 20A), RIG-I (FIG. 20B), IL-2 (FIG. 20C), IL-6 (FIG. 20D), IFNγ (FIG. 20E), and TNFα (FIG. 20F) after electroporation of human CD3+ T cells with modified linear, unpurified circular, or purified circular RNA.
Figure 20B:
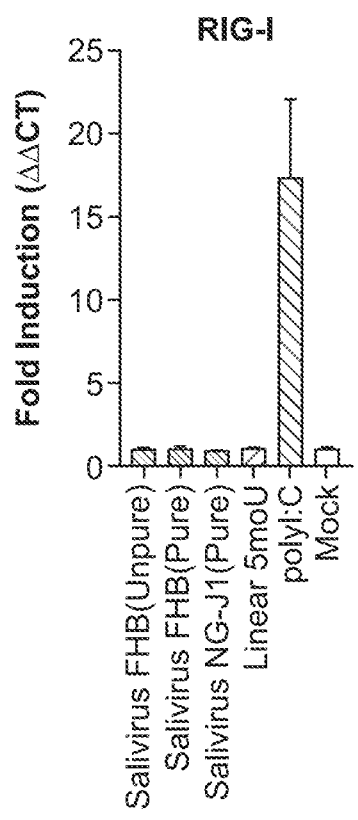
Figure 20C:
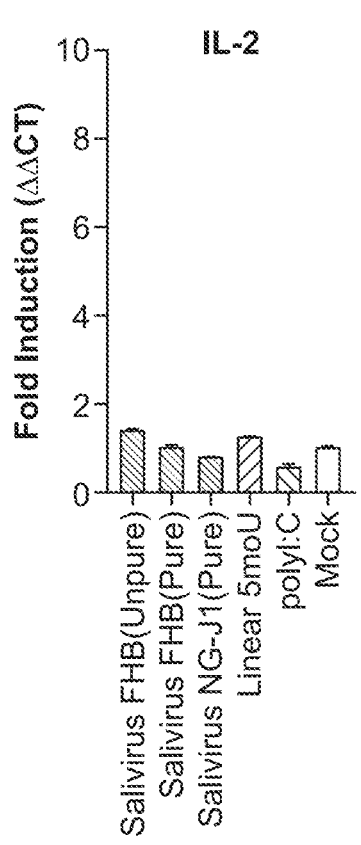
Figure 20D:
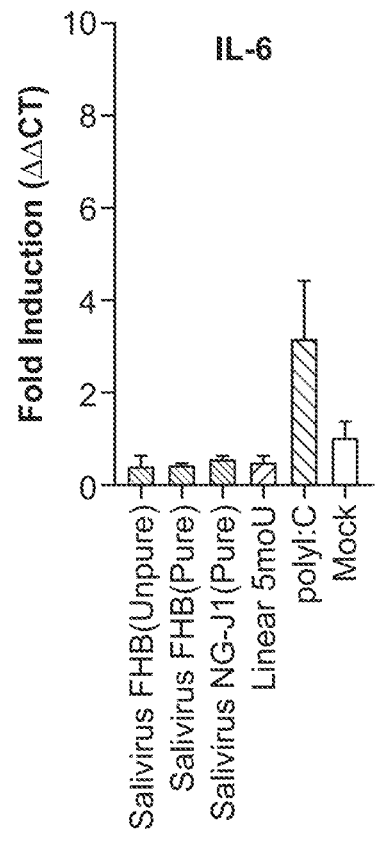
Figure 20E:
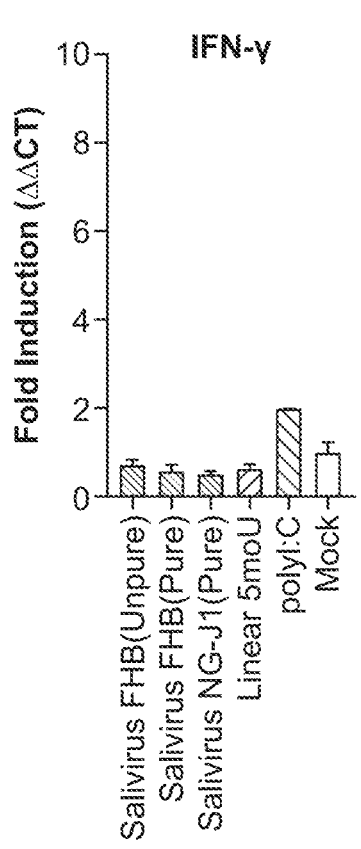
Figure 20F:
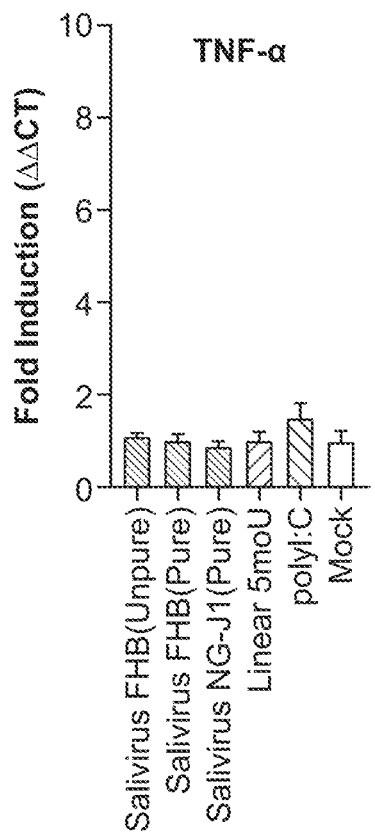

Constructs including anabaena intron/exon regions, a *Gaussia* luciferase expression sequence, and a subset of previously tested IRES were circularized and reaction products were purified by size exclusion HPLC. 150,000 CD3+ human T cells were electroporated with 1 μg of circular RNA, 5moU-mRNA, or immunostimulatory positive control poly inosine:cytosine. IFN-β1 (FIG. 20A), RIG-I (FIG. 20B), IL-2 (FIG. 20C), IL-6 (FIG. 20D), IFN-γ (FIG. 20E), and TNF-α (FIG. 20F) transcript induction was measured 18 hours after electroporation.

Example 20

Specific Lysis of Target Cells and IFNγ Transcript Induction by CAR Expressing Cells Electroporated with Different Amounts of Circular or Linear RNA; Specific Lysis of Target and Non-Target Cells by CAR Expressing Cells at Different E: T Ratios.

Figure 21A:
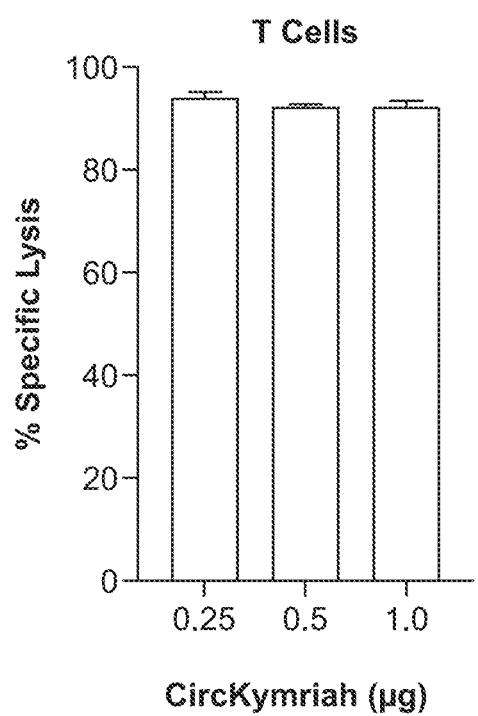
FIGS. 21A and 21B depict specific lysis of Raji target cells by human primary CD3+ T cells electroporated with circRNA encoding a CAR as determined by detection of firefly luminescence (FIG. 21A), and IFNγ transcript induction 24 hours after electroporation with different quantities of circular or linear RNA encoding a CAR sequence (FIG. 21B).
Figure 21B:
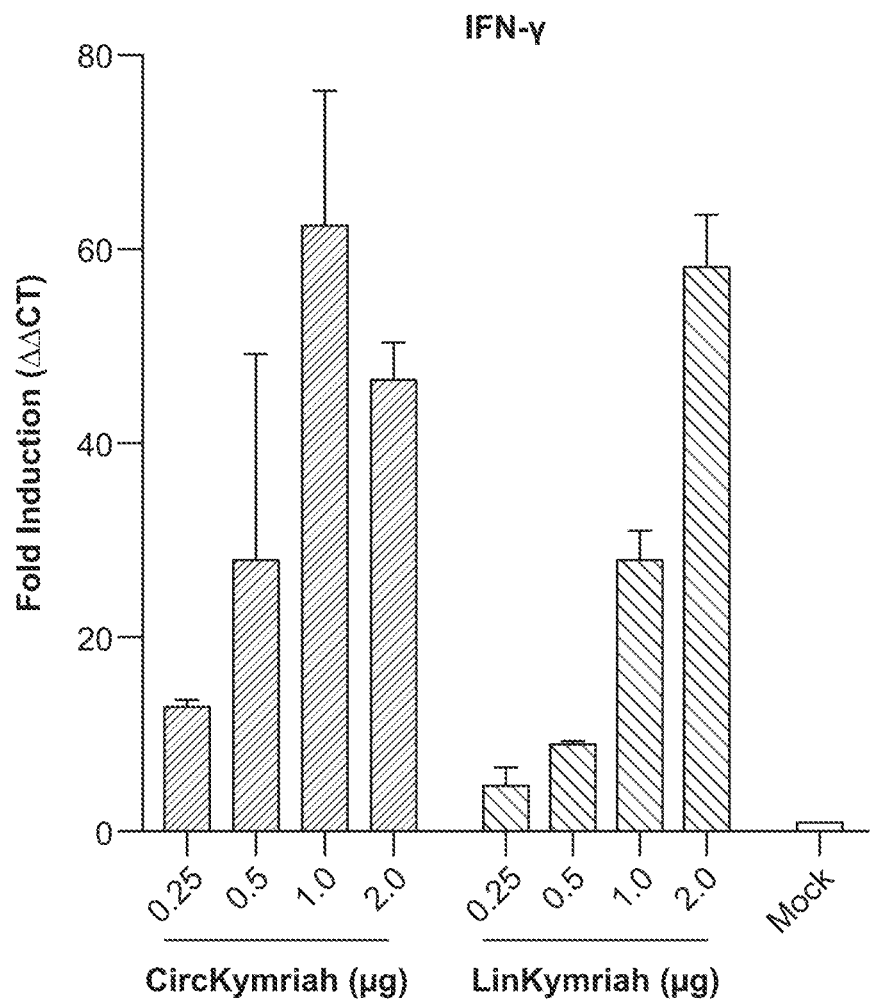

Constructs including anabaena intron/exon regions, an anti-CD19 CAR expression sequence, and a CVB3 IRES were circularized and reaction products were purified by size exclusion HPLC. 150,000 human primary CD3+ T cells either mock electroporated or electroporated with different quantities of circRNA encoding an anti-CD19 CAR sequence were co-cultured for 12 hours with Raji cells stably expressing GFP and firefly luciferase at an E:T ratio of 2:1. Specific lysis of Raji target cells was determined by detection of firefly luminescence (FIG. 21A). % Specific lysis was defined as 1-[CAR condition luminescence]/[mock condition luminescence]. IFNγ transcript induction was measured 24 hours after electroporation (FIG. 21).

Figure 22A:
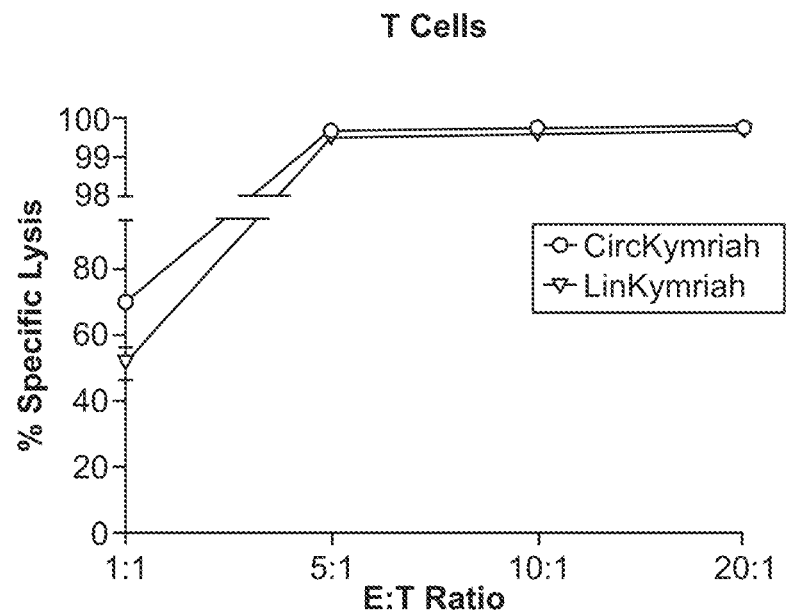
FIGS. 22A and 22B depict specific lysis of target or non-target cells by human primary CD3+ T cells electroporated with circular or linear RNA encoding a CAR at different E:T ratios (FIG. 22A and FIG. 22B) as determined by detection of firefly luminescence.

150,000 human primary CD3+ T cells were either mock electroporated or electroporated with 500 ng circRNA or m1ψ-mRNA encoding an anti-CD19 CAR sequence, then co-cultured for 24 hours with Raji cells stably expressing firefly luciferase at different E:T ratios. Specific lysis of Raji target cells was determined by detection of firefly luminescence (FIG. 22A). Specific lysis was defined as 1-[CAR condition luminescence]/[mock condition luminescence].

Figure 22B:
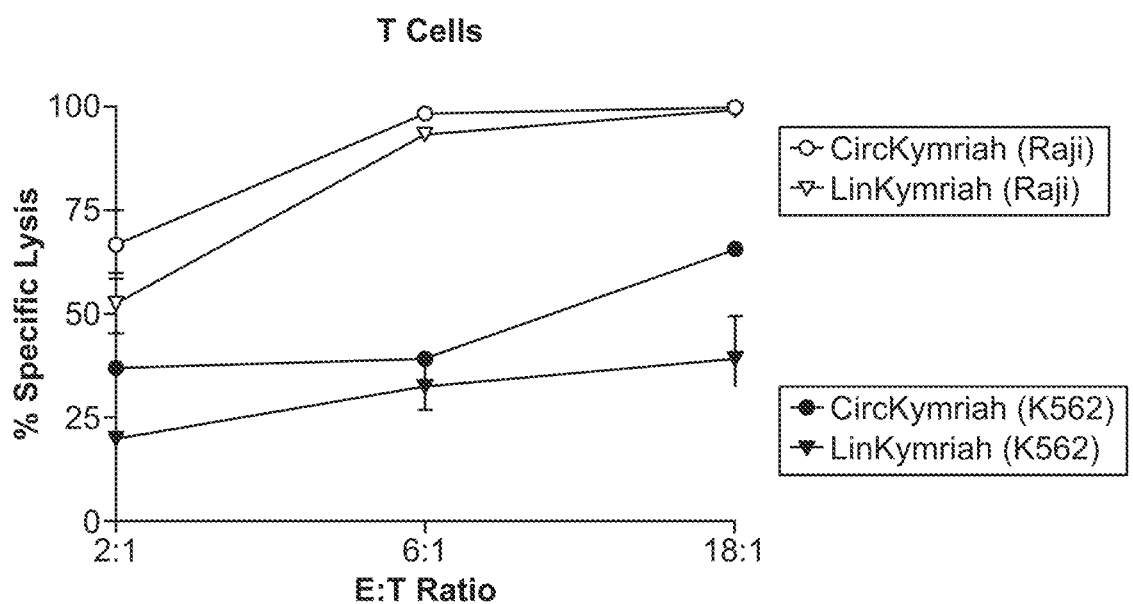

CAR expressing T cells were also co-cultured for 24 hours with Raji or K562 cells stably expressing firefly luciferase at different E:T ratios. Specific lysis of Raji target cells or K562 non-target cells was determined by detection of firefly luminescence (FIG. 22B). % Specific lysis is defined as 1-[CAR condition luminescence]/[mock condition luminescence].

Example 21

Specific Lysis of Target Cells by T Cells Electroporated with Circular RNA or Linear RNA Encoding a CAR.

Figure 23:
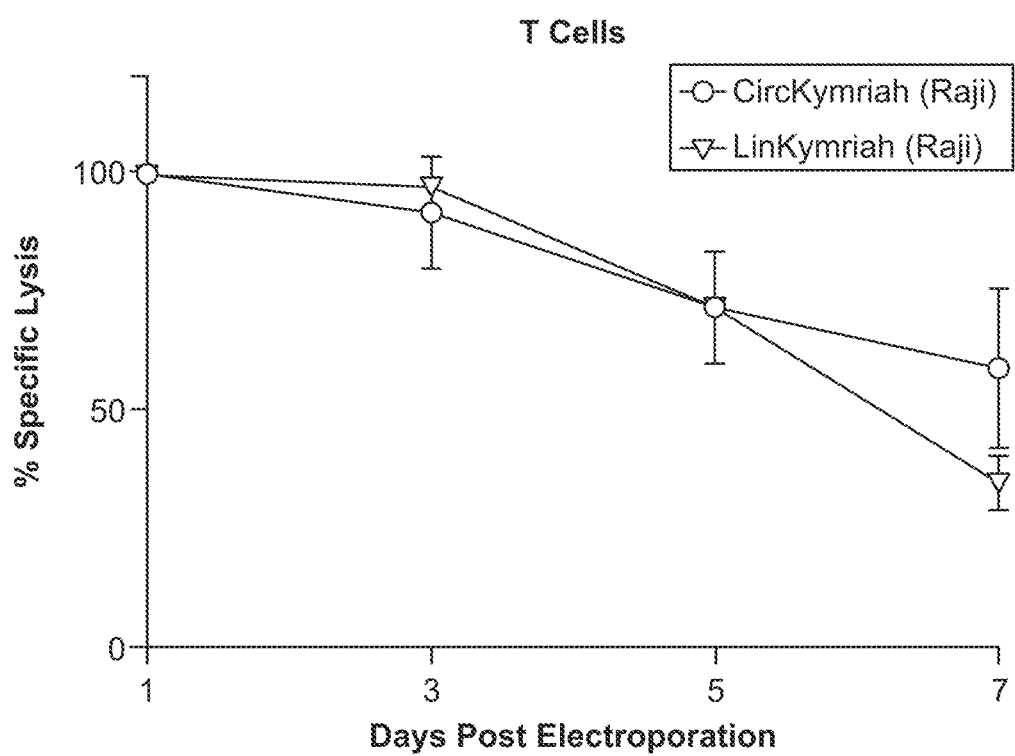
FIG. 23 depicts specific lysis of target cells by human CD3+ T cells electroporated with RNA encoding a CAR at 1, 3, 5, and 7 days post electroporation.

Constructs including anabaena intron/exon regions, an anti-CD19 CAR expression sequence, and a CVB3 IRES were circularized and reaction products were purified by size exclusion HPLC. Human primary CD3+ T cells were electroporated with 500 ng of circular RNA or an equimolar quantity of m1ψ-mRNA, each encoding a CD19-targeted CAR. Raji cells were added to CAR-T cell cultures over 7 days at an E:T ratio of 10:1. % Specific lysis was measured for both constructs at 1, 3, 5, and 7 days (FIG. 23).

Example 22

Specific Lysis of Raji Cells by T Cells Expressing an Anti-CD19 CAR or an Anti-BCMA CAR.

Figure 24:
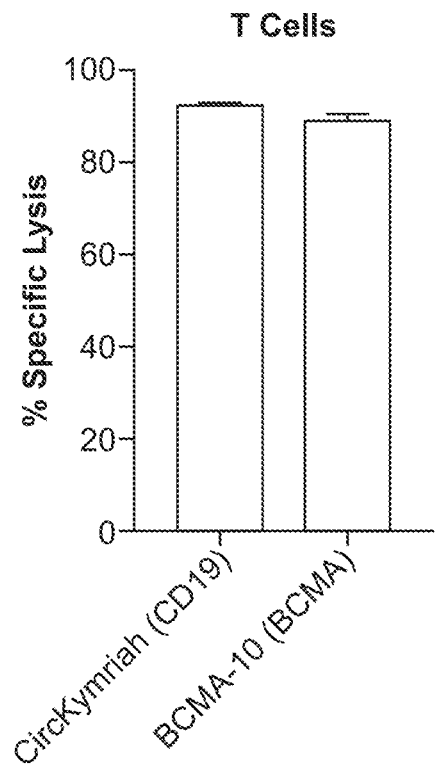
FIG. 24 depicts specific lysis of target cells by human CD3+ T cells electroporated with circular RNA encoding a CD19 or BCMA targeted CAR.

Constructs including anabaena intron/exon regions, anti-CD19 or anti-BCMA CAR expression sequence, and a CVB3 IRES were circularized and reaction products were purified by size exclusion HPLC. 150,000 primary human CD3+ T cells were electroporated with 500 ng of circRNA, then were co-cultured with Raji cells at an E:T ratio of 2:1. % Specific lysis was measured 12 hours after electroporation (FIG. 24).

Example 23

Expression, Functional Stability, and Cytokine Transcript Induction of Circular and Linear RNA Expressing Antigens.

Constructs including one or more antigen expression sequences are circularized and reaction products are purified by size exclusion HPLC. Antigen presenting cells are electroporated with circular RNA or mRNA.

In vitro antigen production is measured via ELISA. Optionally, antigen production is measured every 24 hours after electroporation. Cytokine transcript induction or release is measured 18 hours after electroporation of antigen presenting cells with circular or linear RNA encoding antigens. The tested cytokines may include IFN-β1, RIG-I, IL-2, IL-6, IFNγ, RANTES, and TNFα.

In vitro antigen production and cytokine induction are measured using purified circRNA, purified circRNA plus antisense circRNA, and unpurified circRNA in order to find the ratio that best preserves expression and immune stimulation.

Example 24

In Vivo Antigen and Antibody Expression in Animal Models.

To assess the ability of antigen encoding circRNAs to facilitate antigen expression and antibody production in vivo, escalating doses of RNA encoding one or more antigens is introduced into mice via intramuscular injection.

Mice are injected once, blood collected after 28 days, then injected again, with blood collected 14 days thereafter. Neutralizing antibodies against antigen of interest is measured via ELISA.

Example 25

Protection Against Infection.

To assess the ability of antigen encoding circRNAs to protect against or cure an infection, RNA encoding one or more antigens of a virus (such as influenza) is introduced into mice via intramuscular injection.

Mice receive an initial injection and boost injections of circRNA encoding one or more antigens. Protection from a virus such as influenza is determined by weight loss and mortality over 2 weeks.

Example 26

Example 26A: Synthesis of Compounds

Synthesis of representative ionizable lipids of the invention are described in PCT applications PCT/US2016/052352, PCT/US2016/068300, PCT/US2010/061058, PCT/US2018/058555, PCT/US2018/053569, PCT/US2017/028981, PCT/US2019/025246, PCT/US2018/035419, PCT/US2019/015913, and US applications with publication numbers 20190314524, 20190321489, and 20190314284, the contents of each of which are incorporated herein by reference in their entireties.

Example 26B: Synthesis of Compounds

Synthesis of representative ionizable lipids of the invention are described in US patent publication number US20170210697A1, the contents of which is incorporated herein by reference in its entirety.

Example 27

Protein Expression by Organ

Circular or linear RNA encoding FLuc was generated and loaded into transfer vehicles with the following formulation: 50% ionizable Lipid 10b-15 represented by

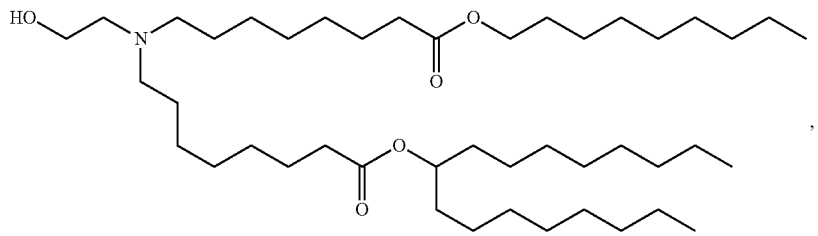 [SMILES: CCCCCCCCCOC(=O)CCCCCCCN(CCO)CCCCCCCC(=O)OC(CCCCCCCC)CCCCCCCC]

Figure 25:
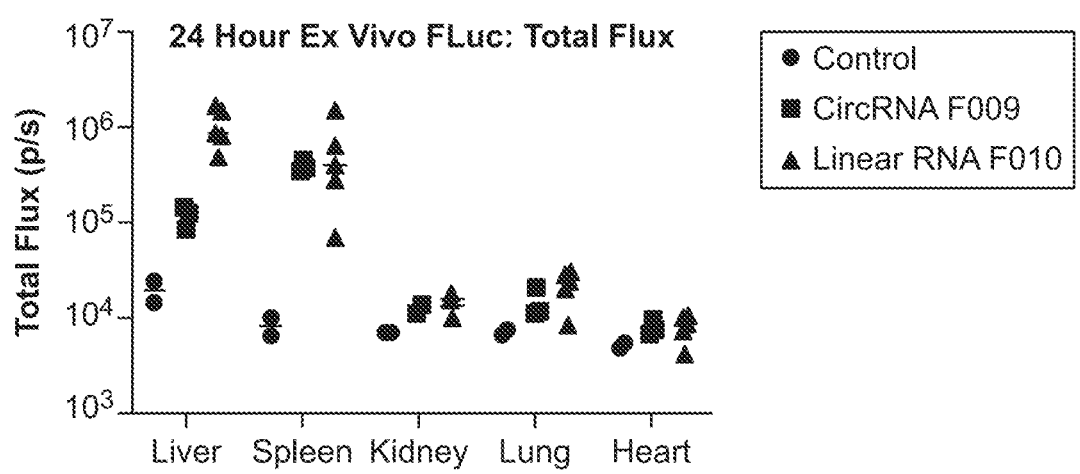
FIG. 25 depicts total Flux of organs harvested from CD-1 mice dosed with circular RNA encoding FLuc and formulated with 50% Lipid 10b-15, 10% DSPC, 1.5% PEG-DMG, and 38.5% cholesterol.
Figure 26:
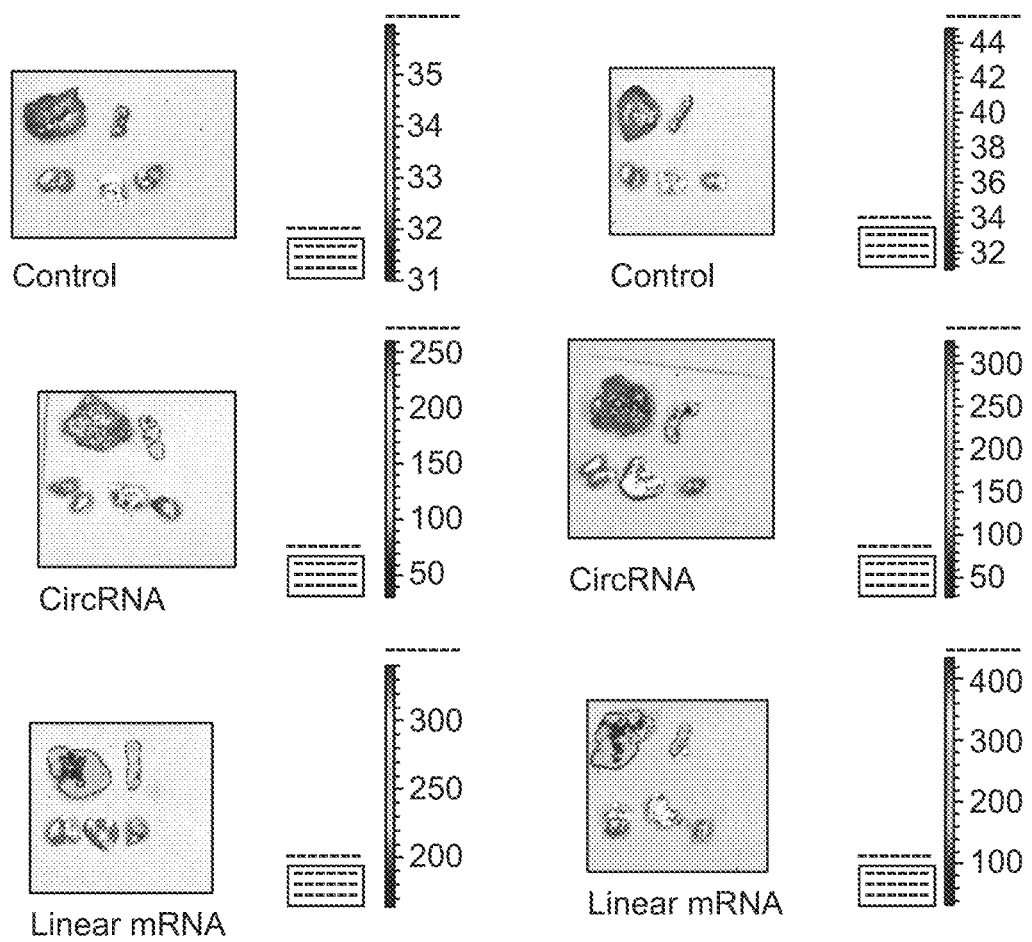
FIG. 26 shows images highlighting the luminescence of organs harvested from CD-1 mice dosed with circular RNA encoding FLuc and formulated with 50% Lipid 10b-15, 10% DSPC, 1.5% PEG-DMG, and 38.5% cholesterol.

10% DSPC, 1.5% PEG-DMG, 38.5% cholesterol. CD-1 mice were dosed at 0.2 mg/kg and luminescence was measured at 6 hours (live IVIS) and 24 hours (live IVIS and ex vivo IVIS). Total Flux (photons/second over a region of interest) of the liver, spleen, kidney, lung, and heart was measured (FIGS. 25 and 26).

Example 28

Distribution of Expression in the Spleen

Circular or linear RNA encoding GFP is generated and loaded into transfer vehicles with the following formulation: 50% ionizable Lipid 10b-15 represented by

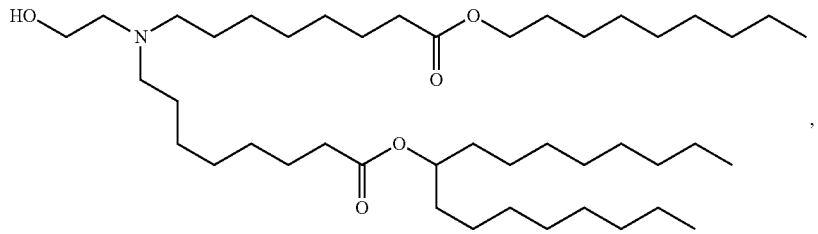 [SMILES: CCCCCCCCCOC(=O)CCCCCCCN(CCO)CCCCCCCC(=O)OC(CCCCCCCC)CCCCCCCC]

10% DSPC, 1.5% PEG-DMG, 38.5% cholesterol. The formulation is administered to CD-1 mice. Flow cytometry is run on spleen cells to determine the distribution of expression across cell types.

Example 29

Example 29A: Production of Nanoparticle Compositions

In order to investigate safe and efficacious nanoparticle compositions for use in the delivery of circular RNA to cells, a range of formulations are prepared and tested. Specifically, the particular elements and ratios thereof in the lipid component of nanoparticle compositions are optimized.

Nanoparticles can be made in a 1 fluid stream or with mixing processes such as microfluidics and T-junction mixing of two fluid streams, one of which contains the circular RNA and the other has the lipid components.

Lipid compositions are prepared by combining an ionizable lipid, optionally a helper lipid (such as DOPE, DSPC, or oleic acid obtainable from Avanti Polar Lipids, Alabaster, AL), a PEG lipid (such as 1,2-dimyristoyl-sn-glycerol methoxypolyethylene glycol, also known as PEG-DMG, obtainable from Avanti Polar Lipids, Alabaster, AL), and a structural lipid such as cholesterol at concentrations of about, e.g., 40 or 50 mM in a solvent, e.g., ethanol. Solutions should be refrigerated for storage at, for example, −20° C. Lipids are combined to yield desired molar ratios (see, for example, Tables 17a and 17b below) and diluted with water and ethanol to a final lipid concentration of e.g., between about 5.5 mM and about 25 mM.

TABLE 17a

| Formulation number | Description |
|---|---|
| 1 | Aliquots of 50 mg/mL ethanolic solutions of C12-200, DOPE, Chol and DMG-PEG2K (40:30:25:5) are mixed and diluted with ethanol to 3 mL final volume. Separately, an aqueous buffered solution (10 mM citrate/150 mM NaCl, pH 4.5) of circRNA is prepared from a 1 mg/mL stock. The lipid solution is injected rapidly into the aqueous circRNA solution and shaken to yield a final suspension in 20% ethanol. The resulting nanoparticle suspension is filtered, diafiltrated with 1 × PBS (pH 7.4), concentrated and stored at 2-8° C. |
| 2 | Aliquots of 50 mg/mL ethanolic solutions of DODAP, DOPE, cholesterol and DMG-PEG2K (18:56:20:6) are mixed and diluted with ethanol to 3 mL final volume. Separately, an aqueous buffered solution (10 mM citrate/150 mM NaCl, pH 4.5) of EPO circRNA is prepared from a 1 mg/mL stock. The lipid solution is injected rapidly into the aqueous circRNA solution and shaken to yield a final suspension in 20% ethanol. The resulting nanoparticle suspension is filtered, diafiltrated with 1 × PBS (pH 7.4), concentrated and stored at 2-8° C. Final concentration = 1.35 mg/mL EPO circRNA (encapsulated). Zave = 75.9 nm (Dv(50) = 57.3 nm; Dv(90) = 92.1 nm). |
| 3 | Aliquots of 50 mg/mL ethanolic solutions of HGT4003, DOPE, cholesterol and DMG-PEG2K (50:25:20:5) are mixed and diluted with ethanol to 3 mL final volume. Separately, an aqueous buffered solution (10 mM citrate/150 mM NaCl, pH 4.5) of circRNA is prepared from a 1 mg/mL stock. The lipid solution is injected rapidly into the aqueous circRNA solution and shaken to yield a final suspension in 20% ethanol. The resulting nanoparticle suspension is filtered, diafiltrated with 1 × PBS (pH 7.4), concentrated and stored at 2-8° C. |
| 4 | Aliquots of 50 mg/mL ethanolic solutions of ICE, DOPE and DMG-PEG2K (70:25:5) are mixed and diluted with ethanol to 3 mL final volume. Separately, an aqueous buffered solution (10 mM citrate/150 mM NaCl, pH 4.5) of circRNA is prepared from a 1 mg/mL stock. The lipid solution is injected rapidly into the aqueous circRNA solution and shaken to yield a final suspension in 20% ethanol. The resulting nanoparticle suspension is filtered, diafiltrated with 1 × PBS (pH 7.4), concentrated and stored at 2-8° C. |
| 5 | Aliquots of 50 mg/mL ethanolic solutions of HGT5000, DOPE, cholesterol and DMG-PEG2K (40:20:35:5) are mixed and diluted with ethanol to 3 mL final volume. Separately, an aqueous buffered solution (10 mM citrate/150 mM NaCl, pH 4.5) of EPO circRNA is prepared from a 1 mg/mL stock. The lipid solution is injected rapidly into the aqueous circRNA solution and shaken to yield a final suspension in 20% ethanol. The resulting nanoparticle suspension is filtered, diafiltrated with 1 × PBS (pH 7.4), concentrated and stored at 2-8° C. Final concentration = 1.82 mg/mL EPO mRNA (encapsulated). Zave = 105.6 nm (Dv(50) = 53.7 nm; Dv(90) = 157 nm). |
| 6 | Aliquots of 50 mg/mL ethanolic solutions of HGT5001, DOPE, cholesterol and DMG-PEG2K (40:20:35:5) are mixed and diluted with ethanol to 3 mL final volume. Separately, an aqueous buffered solution (10 mM citrate/150 mM NaCl, pH 4.5) of EPO circRNA is prepared from a 1 mg/mL stock. The lipid solution is injected rapidly into the aqueous circRNA solution and shaken to yield a final suspension in 20% ethanol. The resulting nanoparticle suspension is filtered, diafiltrated with 1 × PBS (pH 7.4), concentrated and stored at 2-8° C. |
| 7 | Aliquots of 50 mg/mL ethanolic solutions of HGT5001, DOPE, cholesterol and DMG-PEG2K (35:16:46.5:2.5) are mixed and diluted with ethanol to 3 mL final volume. Separately, an aqueous buffered solution (10 mM citrate/150 mM NaCl, pH 4.5) of EPO circRNA is prepared from a 1 mg/mL stock. The lipid solution is injected rapidly into the aqueous circRNA solution and shaken to yield a final suspension in 20% ethanol. The resulting nanoparticle suspension is filtered, diafiltrated with 1 × PBS (pH 7.4), concentrated and stored at 2-8° C. |
| 8 | Aliquots of 50 mg/mL ethanolic solutions of HGT5001, DOPE, cholesterol and DMG-PEG2K (40:10:40:10) are mixed and diluted with ethanol to 3 mL final volume. Separately, an aqueous buffered solution (10 mM citrate/150 mM |

TABLE 17a-continued

| Formulation number | Description |
|---|---|
|  | NaCl, pH 4.5) of EPO circRNA is prepared from a 1 mg/mL stock. The lipid solution is injected rapidly into the aqueous circRNA solution and shaken to yield a final suspension in 20% ethanol. The resulting nanoparticle suspension is filtered, diafiltrated with 1 × PBS (pH 7.4), concentrated and stored at 2-8° C. |
| 9 | Aliquots of 50 mg/mL ethanolic solutions of LP-01, DSPC, cholesterol and DMG-PEG2K (45:9:44:2) are mixed and diluted with ethanol to 3 mL final volume. Separately, an aqueous buffered solution (50 mM Na Acetate, pH 4.5) of FLuc, hEPO, micro-dystrophin, mini-dystrophin, or dystrophin circRNA is prepared from a 1 mg/mL stock. The lipid solution is injected rapidly into the aqueous circRNA solution and shaken to yield a final suspension in 25% ethanol. The resulting nanoparticle suspension is filtered, diafiltrated with 1 × PBS (pH 7.4), concentrated and stored at 2-8° C. |
| 10 | Aliquots of 50 mg/mL ethanolic solutions of LP-01, DSPC, cholesterol and DMG-PEG2K, and DMSO solution of Ethyl Lauroyl Arginate (38.25:7.65:37.4:1.7:15) are mixed and diluted with ethanol to 3 mL final volume. Separately, an aqueous buffered solution (50 mM Bis-Tris, pH 7.0) of FLuc, hEPO, micro-dystrophin, mini-dystrophin, or dystrophin circRNA is prepared from a 1 mg/mL stock. The lipid solution is injected rapidly into the aqueous circRNA solution and shaken to yield a final suspension in 25% ethanol. The resulting nanoparticle suspension is filtered, diafiltrated with 1 × PBS (pH 7.4), concentrated and stored at 2-8° C. |
| 11 | Aliquots of 50 mg/mL ethanolic solutions of SM-102, DSPC, cholesterol and DMG-PEG2K (50:10:38.5:1.5) are mixed and diluted with ethanol to 3 mL final volume. Separately, an aqueous buffered solution (6.25 mM Na Acetate, pH 4.5) of FLuc, hEPO, micro-dystrophin, mini-dystrophin, or dystrophin circRNA is prepared from a 1 mg/mL stock. The lipid solution is injected rapidly into the aqueous circRNA solution and shaken to yield a final suspension in 25% ethanol. The resulting nanoparticle suspension is filtered, diafiltrated with 1 × PBS (pH 7.4), concentrated and stored at 2-8° C. |
| 12 | Aliquots of 50 mg/mL ethanolic solutions of SM-102, DSPC, cholesterol and DMG-PEG2K, and DMSO solution of Ethyl Lauroyl Arginate (42.5:8.5:32.73:1.275:15) are mixed and diluted with ethanol to 3 mL final volume. Separately, an aqueous buffered solution (20 mM Na Acetate, pH 4.5) of FLuc, hEPO, micro-dystrophin, mini-dystrophin, or dystrophin circRNA is prepared from a 1 mg/mL stock. The lipid solution is injected rapidly into the aqueous circRNA solution and shaken to yield a final suspension in 25% ethanol. The resulting nanoparticle suspension is filtered, diafiltrated with 1 × PBS (pH 7.4), concentrated and stored at 2-8° C. |

In some embodiments, transfer vehicle has a formulation as described in Table 17a.

TABLE 17b

| Composition (mol %) | Components |
|---|---|
| 40:20:38.5:1.5 | Compound:Phospholipid:Phytosterol*:PEG-DMG |
| 45:15:38.5:1.5 | Compound:Phospholipid:Phytosterol*:PEG-DMG |
| 50:10:38.5:1.5 | Compound:Phospholipid:Phytosterol*:PEG-DMG |
| 55:5:38.5:1.5 | Compound:Phospholipid:Phytosterol*:PEG-DMG |
| 60:5:33.5:1.5 | Compound:Phospholipid:Phytosterol*:PEG-DMG |
| 45:20:33.5:1.5 | Compound:Phospholipid:Phytosterol*:PEG-DMG |
| 50:20:28.5:1.5 | Compound:Phospholipid:Phytosterol*:PEG-DMG |
| 55:20:23.5:1.5 | Compound:Phospholipid:Phytosterol*:PEG-DMG |
| 60:20:18.5:1.5 | Compound:Phospholipid:Phytosterol*:PEG-DMG |
| 40:15:43.5:1.5 | Compound:Phospholipid:Phytosterol*:PEG-DMG |
| 50:15:33.5:1.5 | Compound:Phospholipid:Phytosterol*:PEG-DMG |
| 55:15:28.5:1.5 | Compound:Phospholipid:Phytosterol*:PEG-DMG |
| 60:15:23.5:1.5 | Compound:Phospholipid:Phytosterol*:PEG-DMG |
| 40:10:48.5:1.5 | Compound:Phospholipid:Phytosterol*:PEG-DMG |
| 45:10:43.5:1.5 | Compound:Phospholipid:Phytosterol*:PEG-DMG |
| 55:10:33.5:1.5 | Compound:Phospholipid:Phytosterol*:PEG-DMG |
| 60:10:28.5:1.5 | Compound:Phospholipid:Phytosterol*:PEG-DMG |
| 40:5:53.5:1.5 | Compound:Phospholipid:Phytosterol*:PEG-DMG |
| 45:5:48.5:1.5 | Compound:Phospholipid:Phytosterol*:PEG-DMG |
| 50:5:43.5:1.5 | Compound:Phospholipid:Phytosterol*:PEG-DMG |
| 40:20:40:0 | Compound:Phospholipid:Phytosterol*:PEG-DMG |
| 45:20:35:0 | Compound:Phospholipid:Phytosterol*:PEG-DMG |
| 50:20:30:0 | Compound:Phospholipid:Phytosterol*:PEG-DMG |
| 55:20:25:0 | Compound:Phospholipid:Phytosterol*:PEG-DMG |
| 60:20:20:0 | Compound:Phospholipid:Phytosterol*:PEG-DMG |
| 45:15:45:0 | Compound:Phospholipid:Phytosterol*:PEG-DMG |

In some embodiments, transfer vehicle has a formulation as described in Table 17b.

For nanoparticle compositions including circRNA, solutions of the circRNA at concentrations of 0.1 mg/ml in deionized water are diluted in a buffer, e.g., 50 mM sodium citrate buffer at a pH between 3 and 4 to form a stock solution. Alternatively, solutions of the circRNA at concentrations of 0.15 mg/ml in deionized water are diluted in a buffer, e.g., 6.25 mM sodium acetate buffer at a pH between 3 and 4.5 to form a stock solution.

Nanoparticle compositions including a circular RNA and a lipid component are prepared by combining the lipid solution with a solution including the circular RNA at lipid component to circRNA wt:wt ratios between about 5:1 and about 50:1. The lipid solution is rapidly injected using, e.g., a NanoAssemblr microfluidic based system at flow rates between about 10 ml/min and about 18 ml/min or between about 5 ml/min and about 18 ml/min into the circRNA solution, to produce a suspension with a water to ethanol ratio between about 1:1 and about 4:1.

Nanoparticle compositions can be processed by dialysis to remove ethanol and achieve buffer exchange. Formulations are dialyzed twice against phosphate buffered saline (PBS), pH 7.4, at volumes 200 times that of the primary product using Slide-A-Lyzer cassettes (Thermo Fisher Scientific Inc., Rockford, IL) with a molecular weight cutoff of 10 kDa or 20 kDa. The formulations are then dialyzed overnight at 4° C. The resulting nanoparticle suspension is filtered through 0.2 μm sterile filters (Sarstedt, Numbrecht, Germany) into glass vials and sealed with crimp closures. Nanoparticle composition solutions of 0.01 mg/ml to 0.15 mg/ml are generally obtained.

The method described above induces nano-precipitation and particle formation.

Alternative processes including, but not limited to, T-junction and direct injection, may be used to achieve the same nano-precipitation. B. Characterization of nanoparticle compositions A Zetasizer Nano ZS (Malvern Instruments Ltd, Malvern, Worcestershire, UK) can be used to determine the particle size, the polydispersity index (PDI) and the zeta potential of the nanoparticle compositions in 1×PBS in determining particle size and 15 mM PBS in determining zeta potential.

Ultraviolet-visible spectroscopy can be used to determine the concentration of circRNA in nanoparticle compositions. 100 μL of the diluted formulation in 1×PBS is added to 900 μL of a 4:1 (v/v) mixture of methanol and chloroform. After mixing, the absorbance spectrum of the solution is recorded, for example, between 230 nm and 330 nm on a DU 800 spectrophotometer (Beckman Coulter, Beckman Coulter, Inc., Brea, CA). The concentration of circRNA in the nanoparticle composition can be calculated based on the extinction coefficient of the circRNA used in the composition and on the difference between the absorbance at a wavelength of, for example, 260 nm and the baseline value at a wavelength of, for example, 330 nm.

A QUANT-IT™ RIBOGREEN® RNA assay (Invitrogen Corporation Carlsbad, CA) can be used to evaluate the encapsulation of circRNA by the nanoparticle composition. The samples are diluted to a concentration of approximately 5 μg/mL or 1 μg/mL in a TE buffer solution (10 mM Tris-HCl, 1 mM EDTA, pH 7.5). 50 μL of the diluted samples are transferred to a polystyrene 96 well plate and either 50 μL of TE buffer or 50 μL of a 2-4% Triton X-100 solution is added to the wells. The plate is incubated at a temperature of 37° C. for 15 minutes. The RIBOGREEN® reagent is diluted 1:100 or 1:200 in TE buffer, and 100 μL of this solution is added to each well. The fluorescence intensity can be measured using a fluorescence plate reader (Wallac Victor 1420 Multilabel Counter; Perkin Elmer, Waltham, MA) at an excitation wavelength of, for example, about 480 nm and an emission wavelength of, for example, about 520 nm. The fluorescence values of the reagent blank are subtracted from that of each of the samples and the percentage of free circRNA is determined by dividing the fluorescence intensity of the intact sample (without addition of Triton X-100) by the fluorescence value of the disrupted sample (caused by the addition of Triton X-100). C.

Example 29B: In Vivo Formulation Studies

In order to monitor how effectively various nanoparticle compositions deliver circRNA to targeted cells, different nanoparticle compositions including circRNA are prepared and administered to rodent populations. Mice are intravenously, intramuscularly, intraarterially, or intratumorally administered a single dose including a nanoparticle composition with a lipid nanoparticle formulation. In some instances, mice may be made to inhale doses. Dose sizes may range from 0.001 mg/kg to 10 mg/kg, where 10 mg/kg describes a dose including 10 mg of a circRNA in a nanoparticle composition for each 1 kg of body mass of the mouse. A control composition including PBS may also be employed.

Upon administration of nanoparticle compositions to mice, dose delivery profiles, dose responses, and toxicity of particular formulations and doses thereof can be measured by enzyme-linked immunosorbent assays (ELISA), bioluminescent imaging, or other methods. Time courses of protein expression can also be evaluated. Samples collected from the rodents for evaluation may include blood and tissue (for example, muscle tissue from the site of an intramuscular injection and internal tissue); sample collection may involve sacrifice of the animals.

Higher levels of protein expression induced by administration of a composition including a circRNA will be indicative of higher circRNA translation and/or nanoparticle composition circRNA delivery efficiencies. As the non-RNA components are not thought to affect translational machineries themselves, a higher level of protein expression is likely indicative of a higher efficiency of delivery of the circRNA by a given nanoparticle composition relative to other nanoparticle compositions or the absence thereof.

Example 30

Characterization of Nanoparticle Compositions

A Zetasizer Nano ZS (Malvern Instruments Ltd, Malvern, Worcestershire, UK) can be used to determine the particle size, the polydispersity index (PDI) and the zeta potential of the transfer vehicle compositions in 1×PBS in determining particle size and 15 mM PBS in determining zeta potential.

Ultraviolet-visible spectroscopy can be used to determine the concentration of a therapeutic and/or prophylactic (e.g., RNA) in transfer vehicle compositions. 100 μL of the diluted formulation in 1×PBS is added to 900 μL of a 4:1 (v/v) mixture of methanol and chloroform. After mixing, the absorbance spectrum of the solution is recorded, for example, between 230 nm and 330 nm on a DU 800 spectrophotometer (Beckman Coulter, Beckman Coulter, Inc., Brea, CA). The concentration of therapeutic and/or prophylactic in the transfer vehicle composition can be calculated based on the extinction coefficient of the therapeutic and/or prophylactic used in the composition and on the difference between the absorbance at a wavelength of, for example, 260 nm and the baseline value at a wavelength of, for example, 330 nm.

For transfer vehicle compositions including RNA, a QUANT-IT™ RIBOGREEN® RNA assay (Invitrogen Corporation Carlsbad, CA) can be used to evaluate the encapsulation of RNA by the transfer vehicle composition. The samples are diluted to a concentration of approximately g/mL or 1 µg/mL in a TE buffer solution (10 mM Tris-HCl, 1 mM EDTA, pH 7.5). 50 µL of the diluted samples are transferred to a polystyrene 96 well plate and either 50 µL of TE buffer or 50 µL of a 2-4% Triton X-100 solution is added to the wells. The plate is incubated at a temperature of 37° C. for 15 minutes. The RIBOGREEN® reagent is diluted 1:100 or 1:200 in TE buffer, and 100 µL of this solution is added to each well. The fluorescence intensity can be measured using a fluorescence plate reader (Wallac Victor 1420 Multilablel Counter; Perkin Elmer, Waltham, MA) at an excitation wavelength of, for example, about 480 nm and an emission wavelength of, for example, about 520 nm. The fluorescence values of the reagent blank are subtracted from that of each of the samples and the percentage of free RNA is determined by dividing the fluorescence intensity of the intact sample (without addition of Triton X-100) by the fluorescence value of the disrupted sample (caused by the addition of Triton X-100).

Example 31

T Cell Targeting

To target transfer vehicles to T-cells, T cell antigen binders, e.g., anti-CD8 antibodies, are coupled to the surface of the transfer vehicle. Anti-T cell antigen antibodies are mildly reduced with an excess of DTT in the presence of EDTA in PBS to expose free hinge region thiols. To remove DTT, antibodies are passed through a desalting column. The heterobifunctional cross-linker SM(PEG)24 is used to anchor antibodies to the surface of circRNA-loaded transfer vehicles (Amine groups are present in the head groups of PEG lipids, free thiol groups on antibodies were created by DTT, SM(PEG)24 cross-links between amines and thiol groups). Transfer vehicles are first incubated with an excess of SM(PEG)24 and centrifuged to remove unreacted cross-linker. Activated transfer vehicles are then incubated with an excess of reduced anti-T cell antigen antibody. Unbound antibody is removed using a centrifugal filtration device.

Example 32

RNA Containing Transfer Vehicle Using RV88.

In this example RNA containing transfer vehicles are synthesized using the 2-D vortex microfluidic chip with the cationic lipid RV88 for delivery of circRNA.

TABLE 18a

| Materials and Instrument | Vendor | Cat # |
|---|---|---|
| 1M Tris-HCl, pH 6.0, Sterile | Teknova | T1080 |
| 5M Sodium Chloride solution | Teknova | S0250 |
| QB Citrate buffer, pH 6.0 (100 mM) | Teknova | Q2446 |
| Nuclease-free water | Ambion | AM9937 |
| Triton X-100 | Sigma-Aldrich | T8787-100ML |
| RV88 | GVK bio | |
| DSPC | Lipoid | 556500 |
| Cholesterol | Sigma | C3045-5G |
| PEG2K | Avanti Polar Lipids | 880150 |
| Ethanol | Acros Organic | 615090010 |
| 5 mL Borosilicate glass vials | Thermo Scientific | ST5-20 |
| PD MiniTrap G-25 Desalting Columns | GE Healthcare | VWR Cat. #95055-984 |
| Quant-iT RiboGreen RNA Assay kit | Molecular Probes/Life Technologies | R11490 |
| Black 96-well microplates | Greiner | 655900 |

RV88, DSPC, and cholesterol all being prepared in ethanol at a concentration of 10 mg/ml in borosilica vials. The lipid 14:0-PEG2K PE is prepared at a concentration of 4 mg/ml also in a borosilica glass vial. Dissolution of lipids at stock concentrations is attained by sonication of the lipids in ethanol for 2 min. The solutions are then heated on an orbital tilting shaker set at 170 rpm at 37° C. for 10 min. Vials are then equilibrated at 26° C. for a minimum of 45 min. The lipids are then mixed by adding volumes of stock lipid as shown in Table 18b. The solution is then adjusted with ethanol such that the final lipid concentration was 7.92 mg/ml.

TABLE 18b

| Composition | MW | % | nmoles | mg | Stock (mg/ml) | ul | Ethanol (ul) |
|---|---|---|---|---|---|---|---|
| RV88 | 794.2 | 40% | 7200 | 5.72 | 10 | 571.8 | 165.3 |
| DSPC | 790.15 | 10% | 1800 | 1.42 | 10 | 142.2 | |
| Cholesterol | 386.67 | 48% | 8640 | 3.34 | 10 | 334.1 | |
| PEG2K | 2693.3 | 2% | 360 | 0.97 | 4 | 242.4 | |

RNA is prepared as a stock solution with 75 mM Citrate buffer at pH 6.0 and a concentration of RNA at 1.250 mg/ml. The concentration of the RNA is then adjusted to 0.1037 mg/ml with 75 mM citrate buffer at pH 6.0, equilibrated to 26° C. The solution is then incubated at 26° C. for a minimum of 25 min.

The microfluidic chamber is cleaned with ethanol and neMYSIS syringe pumps are prepared by loading a syringe with the RNA solution and another syringe with the ethanolic lipid. Both syringes are loaded and under the control of neMESYS software. The solutions are then applied to the

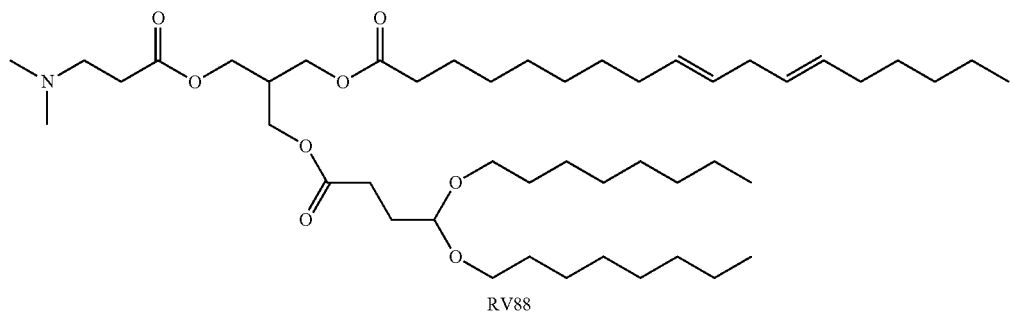 [SMILES: CCCCC/C=C/C/C=C/CCCCCCCC(=O)OCC(COC(=O)CCC(OCCCCCCCC)OCCCCCCCC)COC(=O)CCN(C)C ; "RV88"]

RV88 mixing chip at an aqueous to organic phase ratio of 2 and a total flow rate of 22 ml/min (14.67 ml/min for RNA and 7.33 ml/min for the lipid solution. Both pumps are started synchronously. The mixer solution that flowed from the microfluidic chip is collected in 4×1 ml fractions with the first fraction being discarded as waste. The remaining solution containing the RNA-liposomes is exchanged by using G-25 mini desalting columns to 10 mM Tris-HCl, 1 mM EDTA, at pH 7.5. Following buffer exchange, the materials are characterized for size, and RNA entrapment through DLS analysis and Ribogreen assays, respectively.

Example 33

RNA Containing Transfer Vehicle Using RV94.

In this example, RNA containing liposome are synthesized using the 2-D vortex microfluidic chip with the cationic lipid RV94 for delivery of circRNA.

TABLE 20

| Composition | MW | % | nmoles | mg | Stock (mg/ml) | ul | Ethanol (ul) |
|---|---|---|---|---|---|---|---|
| RV94 | 808.22 | 40% | 2880 | 2.33 | 10 | 232.8 | 155.3 |
| DSPC | 790.15 | 10% | 720 | 0.67 | 10 | 56.9 | |
| Cholesterol | 386.67 | 48% | 3456 | 1.34 | 10 | 133.6 | |
| PEG2K | 2693.3 | 2% | 144 | 0.39 | 4 | 97.0 | |

The aqueous solution of circRNA is prepared as a stock solution with 75 mM Citrate buffer at pH 6.0 the circRNA at 1.250 mg/ml. The concentration of the RNA is then adjusted to 0.1037 mg/ml with 75 mM citrate buffer at pH 6.0, equilibrated to 26° C. The solution is then incubated at 26° C. for a minimum of 25 min.

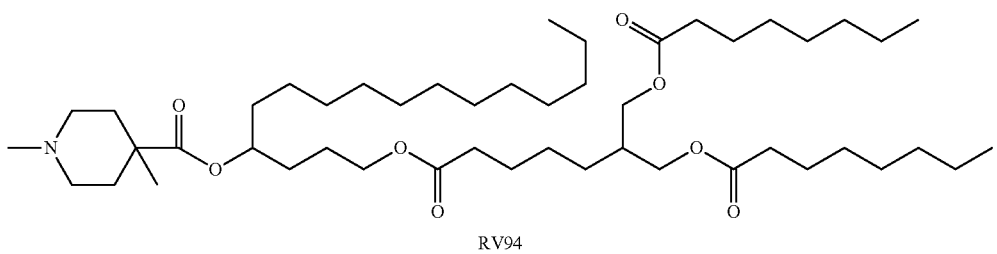 [SMILES: CCCCCCCCCCCCC(CCCOC(=O)CCCCC(COC(=O)CCCCCCC)COC(=O)CCCCCCC)OC(=O)C1(C)CCN(C)CC1 ; "RV94"]

RV94

TABLE 19

| Materials and Instrument | Vendor | Cat # |
|---|---|---|
| 1M Trs-HCl, pH 6.0, Sterile | Teknova | T1080 |
| 5M Sodium Chloride solution | Teknova | S0250 |
| QB Citrate buffer, pH 6.0 (100 mM) | Teknova | Q2446 |
| Nuclease-free water | Ambion | AM9937 |
| Triton X-100 | Sigma-Aldrich | T8787-100ML |
| RV94 | GVKbio | |
| DSPC | Lipid | 556500 |
| Cholesterol | Sigma | C3045-5G |
| PEG2K | Avanti Polar Lipids | 880150 |
| Ethanol | Acros Organic | 615090010 |
| 5 mL Borosilicate glass vials | Thermo Scientific | ST5-20 |
| PD MiniTrap G-25 Desalting Columns | GE Healthcare | VWR Cat #95055-984 |
| Quant-iT RiboGreen RNA Assay kit | Molecular Probes/Life Technologies | R11490 |
| Black 96-well microplates | Greiner | 655900 |

The lipids were prepared as in Example 32 using the material amounts named in Table 19 to a final lipid concentration of 7.92 mg/ml.

The microfluidic chamber is cleaned with ethanol and neMYSIS syringe pumps are prepared by loading a syringe with the RNA solution and another syringe with the ethanolic lipid. Both syringes are loaded and under the control of neMESYS software. The solutions are then applied to the mixing chip at an aqueous to organic phase ratio of 2 and a total flow rate of 22 ml/min (14.67 ml/min for RNA and 7.33 ml/min for the lipid solution. Both pumps are started synchronously. The mixer solution that flowed from the microfluidic chip is collected in 4×1 ml fractions with the first fraction being discarded as waste. The remaining solution containing the circRNA-transfer vehicles is exchanged by using G-25 mini desalting columns to 10 mM Tris-HCl, 1 mM EDTA, at pH 7.5, as described above. Following buffer exchange, the materials are characterized for size, and RNA entrapment through DLS analysis and Ribogreen assays, respectively. The biophysical analysis of the liposomes is shown in Table 21.

TABLE 21

| Sample Name | N:P Ratio | TFR ml/min | Ratio (aqueous/ org phase) | RNA encapsulation amount (μg/ml) | RNA encapsulation yield % | size | |
|---|---|---|---|---|---|---|---|
| | | | | | | d · nm | PDI |
| SAM-RV94 | 8 | 22 | 2 | 31.46 | 86.9 | 113.1 | 0.12 |

Example 34

General Protocol for in Line Mixing.

Individual and separate stock solutions are prepared—one containing lipid and the other circRNA. Lipid stock containing a desired lipid or lipid mixture, DSPC, cholesterol and PEG lipid is prepared by solubilized in 90% ethanol. The remaining 10% is low pH citrate buffer. The concentration of the lipid stock is 4 mg/mL. The pH of this citrate buffer can range between pH 3 and pH 5, depending on the type of lipid employed. The circRNA is also solubilized in citrate buffer at a concentration of 4 mg/mL. 5 mL of each stock solution is prepared.

Stock solutions are completely clear and lipids are ensured to be completely solubilized before combining with circRNA. Stock solutions may be heated to completely solubilize the lipids. The circRNAs used in the process may be unmodified or modified oligonucleotides and may be conjugated with lipophilic moieties such as cholesterol.

The individual stocks are combined by pumping each solution to a T-junction. A dual-head Watson-Marlow pump was used to simultaneously control the start and stop of the two streams. A 1.6 mm polypropylene tubing is further downsized to 0.8 mm tubing in order to increase the linear flow rate. The polypropylene line (ID=0.8 mm) are attached to either side of a T-junction. The polypropylene T has a linear edge of 1.6 mm for a resultant volume of 4.1 mm$^3$. Each of the large ends (1.6 mm) of polypropylene line is placed into test tubes containing either solubilized lipid stock or solubilized circRNA. After the T-junction, a single tubing is placed where the combined stream exited. The tubing is then extended into a container with 2× volume of PBS, which is rapidly stirred. The flow rate for the pump is at a setting of 300 rpm or 110 mL/min. Ethanol is removed and exchanged for PBS by dialysis. The lipid formulations are then concentrated using centrifugation or diafiltration to an appropriate working concentration.

C57BL/6 mice (Charles River Labs, MA) receive either saline or formulated circRNA via tail vein injection. At various time points after administration, serum samples are collected by retroorbital bleed. Serum levels of Factor VII protein are determined in samples using a chromogenic assay (Biophen FVTI, Aniara Corporation, OH). To determine liver RNA levels of Factor VII, animals are sacrificed and livers are harvested and snap frozen in liquid nitrogen. Tissue lysates are prepared from the frozen tissues and liver RNA levels of Factor VII are quantified using a branched DNA assay (QuantiGene Assay, Panomics, CA).

FVII activity is evaluated in FVTI siRNA-treated animals at 48 hours after intravenous (bolus) injection in C57BL/6 mice. FVII is measured using a commercially available kit for determining protein levels in serum or tissue, following the manufacturer's instructions at a microplate scale. FVII reduction is determined against untreated control mice, and the results are expressed as % Residual FVII. Two dose levels (0.05 and 0.005 mg/kg FVII siRNA) are used in the screen of each novel liposome composition.

Example 36 circRNA Formulation Using Preformed Vesicles.

Cationic lipid containing transfer vehicles are made using the preformed vesicle method. Cationic lipid, DSPC, cholesterol and PEG-lipid are solubilized in ethanol at a molar ratio of 40/10/40/10, respectively. The lipid mixture is added to an aqueous buffer (50 mM citrate, pH 4) with mixing to a final ethanol and lipid concentration of 30% (vol/vol) and 6.1 mg/mL respectively and allowed to equilibrate at room temperature for 2 min before extrusion. The hydrated lipids are extruded through two stacked 80 nm pore-sized filters (Nuclepore) at 22° C. using a Lipex Extruder (Northern Lipids, Vancouver, BC) until a vesicle diameter of 70-90 nm, as determined by Nicomp analysis, is obtained. For cationic lipid mixtures which do not form small vesicles, hydrating the lipid mixture with a lower pH buffer (50 mM citrate, pH 3) to protonate the phosphate group on the DSPC headgroup helps form stable 70-90 nm vesicles.

The FVII circRNA (solubilised in a 50 mM citrate, pH 4 aqueous solution containing 30% ethanol) is added to the vesicles, pre-equilibrated to 35° C., at a rate of −5 mL/min with mixing. After a final target circRNA/lipid ratio of 0.06 (wt wt) is achieved, the mixture is incubated for a further 30 min at 35° C. to allow vesicle re-organization and encapsulation of the FVII RNA. The ethanol is then removed and the external buffer replaced with PBS (155 mM NaCl, 3 mM Na2HP04, ImM KH2P04, pH 7.5) by either dialysis or tangential flow diafiltration. The final encapsulated circRNA-to-lipid ratio is determined after removal of unencapsulated RNA using size-exclusion spin columns or ion exchange spin columns.

Example 37

Example 37A: Expression of Trispecific Antigen Binding Proteins from Engineered Circular RNA Circular RNAs are designed to include: (1) a 3' post splicing group I intron fragment; (2) an Internal Ribosome Entry Site (IRES); (3) a trispecific antigen-binding protein coding region; and (4) a 3' homology region. The trispecific antigen-binding protein regions are constructed to produce an exemplary trispecific antigen-binding protein that will bind to a target antigen, e.g., GPC3.

Example 37B: Generation of a scFv CD3 Binding Domain

The human CD3epsilon chain canonical sequence is Uniprot Accession No. P07766. The human CD3gamma chain canonical sequence is Uniprot Accession No. P09693. The human CD3delta chain canonical sequence is Uniprot Accession No. P043234. Antibodies against CD3epsilon, CD3gamma or CD3delta are generated via known technologies such as affinity maturation. Where murine anti-CD3 antibodies are used as a starting material, humanization of murine anti-CD3 antibodies is desired for the clinical setting, where the mouse-specific residues may induce a human-anti-mouse antigen (HAMA) response in subjects who receive treatment of a trispecific antigen-binding protein described herein. Humanization is accomplished by grafting CDR regions from murine anti-CD3 antibody onto appropriate human germline acceptor frameworks, optionally including other modifications to CDR and/or framework regions.

Human or humanized anti-CD3 antibodies are therefore used to generate scFv sequences for CD3 binding domains of a trispecific antigen-binding protein. DNA sequences coding for human or humanized VL and VH domains are obtained, and the codons for the constructs are, optionally, optimized for expression in cells from *Homo sapiens*. The order in which the VL and VH domains appear in the scFv is varied (i.e. VL-VH, or VH-VL orientation), and three copies of the "G4S" or "G$_4$S" subunit (G$_4$S)$_3$ connect the variable domains to create the scFv domain. Anti-CD3 scFv plasmid constructs can have optional Flag, His or other affinity tags, and are electroporated into HEK293 or other suitable human or mammalian cell lines and purified. Validation assays include binding analysis by FACS, kinetic analysis using Proteon, and staining of CD3-expressing cells.

Example 37C: Generation of a scFv Glypican-3 (GPC3) Binding Domain

Glypican-3 (GPC3) is one of the cell surface proteins present on Hepatocellular Carcinoma but not on healthy normal liver tissue. It is frequently observed to be elevated in hepatocellular carcinoma and is associated with poor prognosis for HCC patients. It is known to activate Wnt signalling. GPC3 antibodies have been generated including MDX-1414, HN3, GC33, and YP7.

A scFv binding to GPC-3 or another target antigen is generated similarly to the above method for generation of a scFv binding domain to CD3.

Example 37D: Expression of Trispecific Antigen-Binding Proteins In Vitro

A CHO cell expression system (Flp-In®, Life Technologies), a derivative of CHO-K1 Chinese Hamster ovary cells (ATCC, CCL-61) (Kao and Puck, Proc. Natl. Acad Sci USA 1968; 60(4):1275-81), is used. Adherent cells are subcultured according to standard cell culture protocols provided by Life Technologies.

For adaption to growth in suspension, cells are detached from tissue culture flasks and placed in serum-free medium. Suspension-adapted cells are cryopreserved in medium with 10% DMSO.

Recombinant CHO cell lines stably expressing secreted trispecific antigen-binding proteins are generated by transfection of suspension-adapted cells. During selection with the antibiotic Hygromycin B viable cell densities are measured twice a week, and cells are centrifuged and resuspended in fresh selection medium at a maximal density of $0.1 \times 10^6$ viable cells/mL. Cell pools stably expressing trispecific antigen-binding proteins are recovered after 2-3 weeks of selection at which point cells are transferred to standard culture medium in shake flasks. Expression of recombinant secreted proteins is confirmed by performing protein gel electrophoresis or flow cytometry. Stable cell pools are cryopreserved in DMSO containing medium.

Trispecific antigen-binding proteins are produced in 10-day fed-batch cultures of stably transfected CHO cell lines by secretion into the cell culture supernatant. Cell culture supernatants are harvested after 10 days at culture viabilities of typically >75%. Samples are collected from the production cultures every other day and cell density and viability are assessed. On day of harvest, cell culture supernatants are cleared by centrifugation and vacuum filtration before further use.

Protein expression titers and product integrity in cell culture supernatants are analyzed by SDS-PAGE.

Example 37E: Purification of Trispecific Antigen-Binding Proteins

Trispecific antigen-binding proteins are purified from CHO cell culture supernatants in a two-step procedure. The constructs are subjected to affinity chromatography in a first step followed by preparative size exclusion chromatography (SEC) on Superdex 200 in a second step. Samples are buffer-exchanged and concentrated by ultrafiltration to a typical concentration of >1 mg/mL Purity and homogeneity (typically >90%) of final samples are assessed by SDS PAGE under reducing and non-reducing conditions, followed by immunoblotting using an anti-(half-life extension domain) or anti idiotype antibody as well as by analytical SEC, respectively. Purified proteins are stored at aliquots at −80° C. until use.

Example 38

Expression of Engineered Circular RNA with a Half-Life Extension Domain has Improved Pharmacokinetic Parameters than without a Half-Life Extension Domain The trispecific antigen-binding protein encoded on a circRNA molecule of example 23 is administered to cynomolgus monkeys as a 0.5 mg/kg bolus injection intramuscularly. Another cynomolgus monkey group receives a comparable protein encoded on a circRNA molecule in size with binding domains to CD3 and GPC-3, but lacking a half-life extension domain. A third and fourth group receive a protein encoded on a circRNA molecule with CD3 and half-life extension domain binding domains and a protein with GPC-3 and half-life extension domains, respectively. Both proteins encoded by circRNA are comparable in size to the trispecific antigen-binding protein. Each test group consists of 5 monkeys. Serum samples are taken at indicated time points, serially diluted, and the concentration of the proteins is determined using a binding ELISA to CD3 and/or GPC-3.

Pharmacokinetic analysis is performed using the test article plasma concentrations. Group mean plasma data for each test article conforms to a multi-exponential profile when plotted against the time post-dosing. The data are fit by a standard two-compartment model with bolus input and first-order rate constants for distribution and elimination phases. The general equation for the best fit of the data for i.v. administration is: $c(t)=Ae^{-\alpha t}+Be^{-\beta t}$, where c(t) is the plasma concentration at time t, A and B are intercepts on the Y-axis, and $\alpha$ and $\beta$ are the apparent first-order rate constants for the distribution and elimination phases, respectively. The a-phase is the initial phase of the clearance and reflects distribution of the protein into all extracellular fluid of the animal, whereas the second or β-phase portion of the decay curve represents true plasma clearance. Methods for fitting such equations are well known in the art. For example, A=D/V(a−k21)/(a−p), B=D/V(p−k21)/(a−p), and $\alpha$ and $\beta$ (for $\alpha > \beta$) are roots of the quadratic equation: $r^2+(k12+k21+k10)r+k21k10=0$ using estimated parameters of V=volume of distribution, k10=elimination rate, k12=transfer rate from compartment 1 to compartment 2 and k21=transfer rate from compartment 2 to compartment 1, and D=the administered dose.

Data analysis: Graphs of concentration versus time profiles are made using KaleidaGraph (KaleidaGraph™ V. 3.09 Copyright 1986-1997. Synergy Software. Reading, Pa.). Values reported as less than reportable (LTR) are not included in the PK analysis and are not represented graphically. Pharmacokinetic parameters are determined by compartmental analysis using WinNonlin software (WinNonlin® Professional V. 3.1 WinNonlin™ Copyright 1998-1999. Pharsight Corporation. Mountain View, Calif). Pharmacokinetic parameters are computed as described in Ritschel W A and Kearns G L, 1999, EST: Handbook Of Basic Pharmacokinetics Including Clinical Applications, 5th edition, American Pharmaceutical Assoc., Washington, D C.

It is expected that the trispecific antigen-binding protein encoded on a circRNA molecule of Example 23 has improved pharmacokinetic parameters such as an increase in elimination half-time as compared to proteins lacking a half-life extension domain.

Example 39

Cytotoxicity of the Trispecific Antigen-Binding Protein

The trispecific antigen-binding protein encoded on a circRNA molecule of Example 23 is evaluated in vitro on its mediation of T cell dependent cytotoxicity to GPC-3+ target cells.

Fluorescence labeled GPC3 target cells are incubated with isolated PBMC of random donors or T-cells as effector cells in the presence of the trispecific antigen-binding protein of Example 23. After incubation for 4 h at 37° C. in a humidified incubator, the release of the fluorescent dye from the target cells into the supernatant is determined in a spectrofluorimeter. Target cells incubated without the trispecific antigen-binding protein of Example 23 and target cells totally lysed by the addition of saponin at the end of the incubation serve as negative and positive controls, respectively.

Based on the measured remaining living target cells, the percentage of specific cell lysis is calculated according to the following formula: [1−(number of living targets(sample)/number of living targets(spontaneous))]×100%. Sigmoidal dose response curves and EC50 values are calculated by non-linear regression/4-parameter logistic fit using the GraphPad Software. The lysis values obtained for a given antibody concentration are used to calculate sigmoidal dose-response curves by 4 parameter logistic fit analysis using the Prism software.

Example 40

Synthesis of Ionizable Lipids 40.1 Synthesis of ((3-(2-methyl-1H-imidazol-1-yl)propyl)azanediyl)bis(hexane-6,1-diyl) bis(2-hexyldecanoate)(Lipid 10a-27) and ((3-(1H-imidazol-1-yl)propyl)azanediyl)bis(hexane-6,1-diyl) bis(2-hexyldecanoate)) (Lipid 10a-26)

In a 100 mL round bottom flask connected with condenser, 3-(1H-imidazol-1-yl)propan-1-amine (100 mg, 0.799 mmol) or 3-(2-methyl-1H-imidazol-1-yl)propan-1-amine (0.799 mmol), 6-bromohexyl 2-hexyldecanoate (737.2 mg, 1.757 mmol), potassium carbonate (485 mg, 3.515 mmol) and potassium iodide (13 mg, 0.08 mmol) were mixed in acetonitrile (30 mL), and the reaction mixture was heated to 80° C. for 48 h. The mixture was cooled to room temperature and was filtered through a pad of Celite. The filtrate was diluted with ethyl acetate. After washing with water, brine and dried over anhydrous sodium sulfate. The solvent was evaporated and the crude residue was purified by flash chromatography ($SiO_2$: $CH_2Cl_2$=100% to 10% of methanol in $CH_2Cl_2$) and colorless oil product was obtained (92 mg, 15%). Molecular formula of ((3-(1H-imidazol-1-yl)propyl)azanediyl)bis(hexane-6,1-diyl) bis(2-hexyldecanoate)) is $C_{50}H_{95}N_3O_4$ and molecular weight ($M_w$) is 801.7.

Reaction scheme for synthesis of ((3-(1H-imidazol-1-yl)propyl)azanediyl)bis(hexane-6,1-diyl) bis(2-hexyldecanoate)) (Lipid 10a-26).

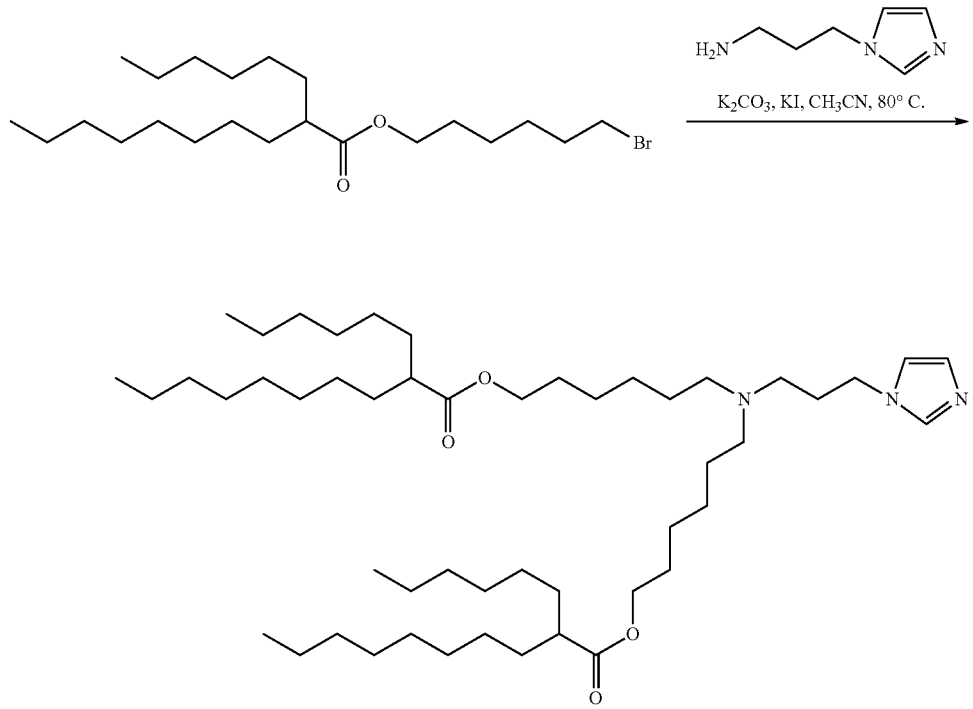

Figure 27A:
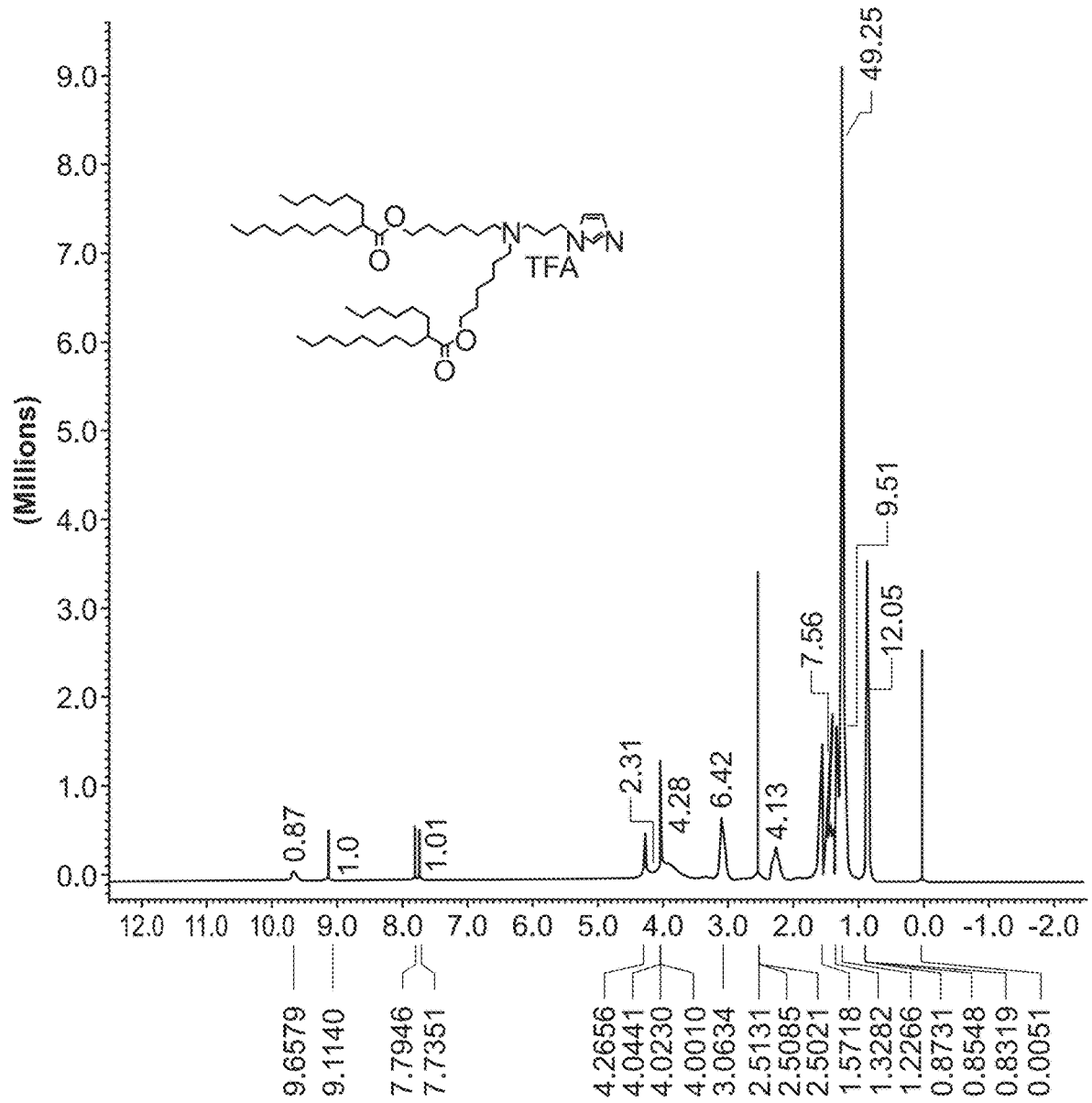
FIGS. 27A-27F depict molecular characterization of Lipids 10a-26 and 10a-27.
Figure 27B:
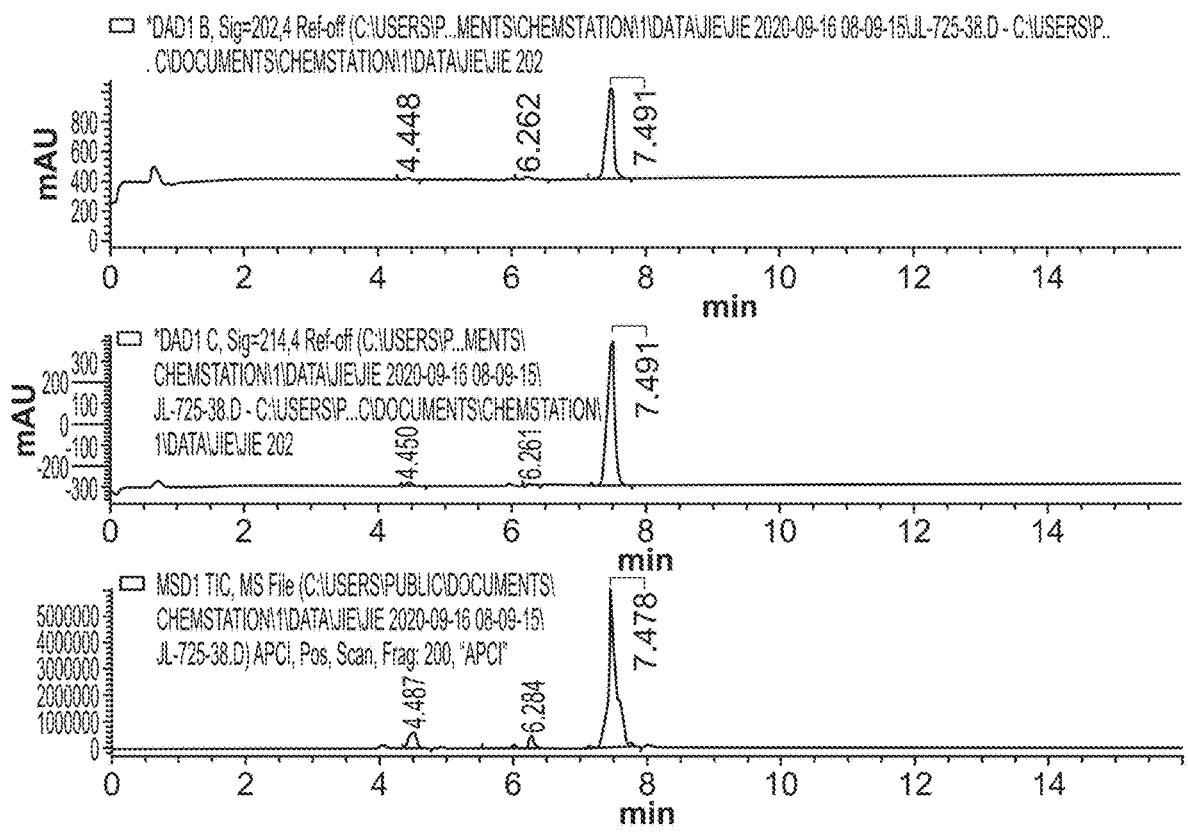
Figure 27C:
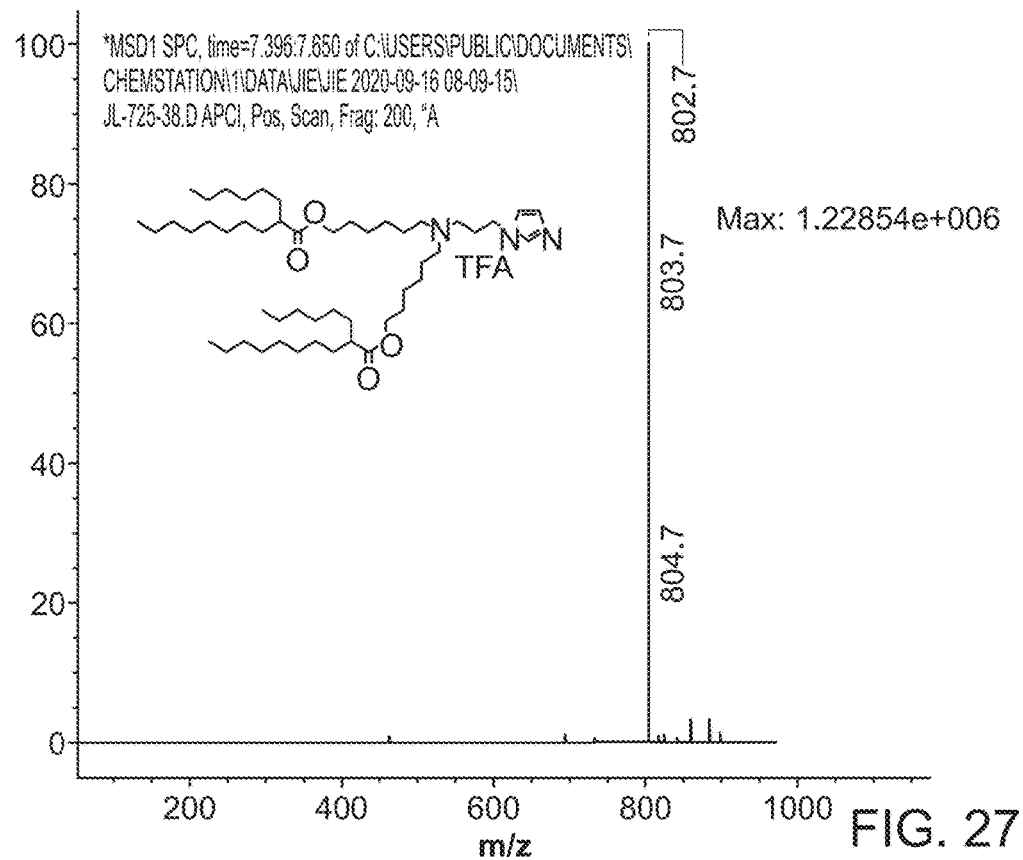
Figure 27D:
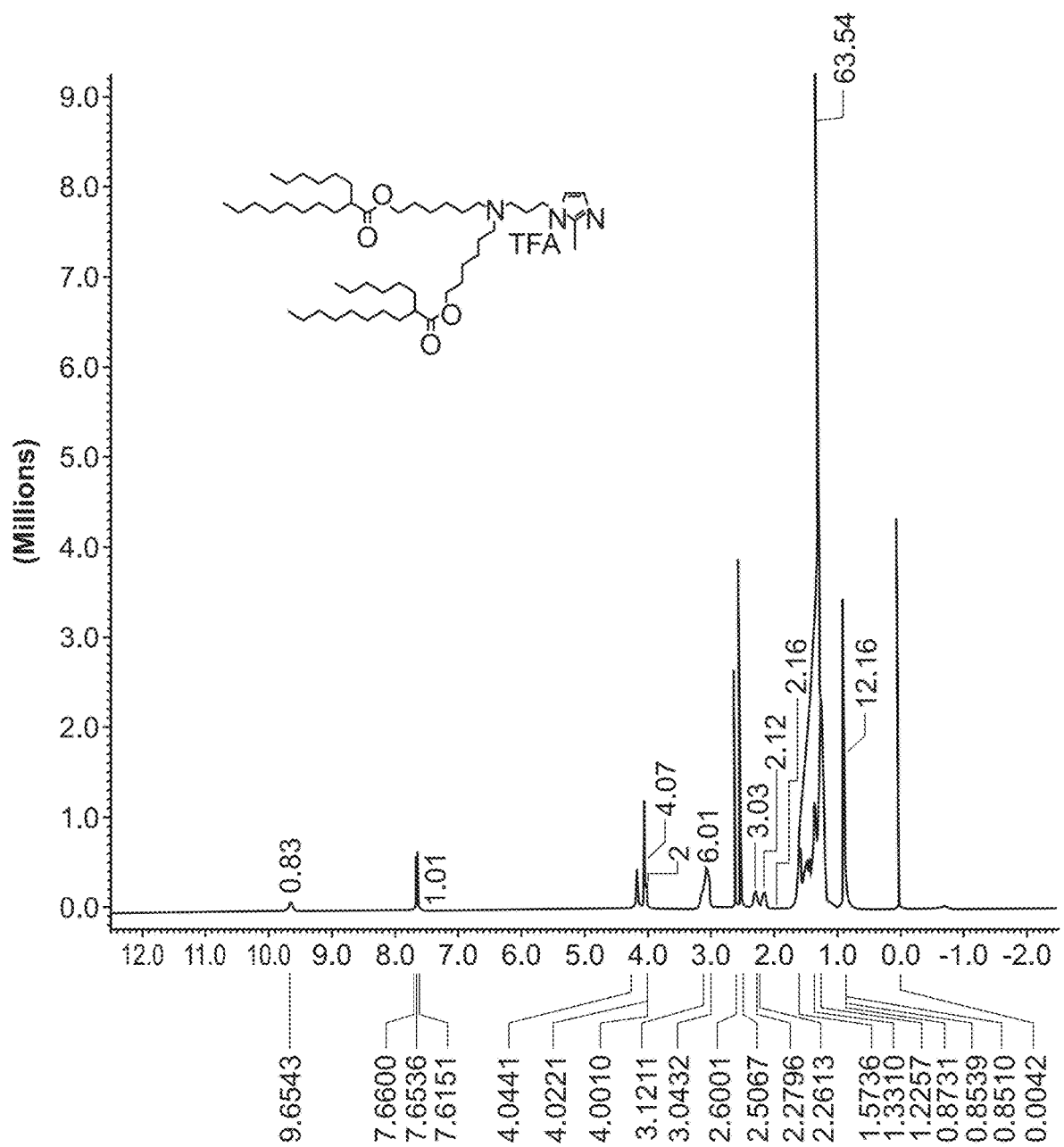
Figure 27E:
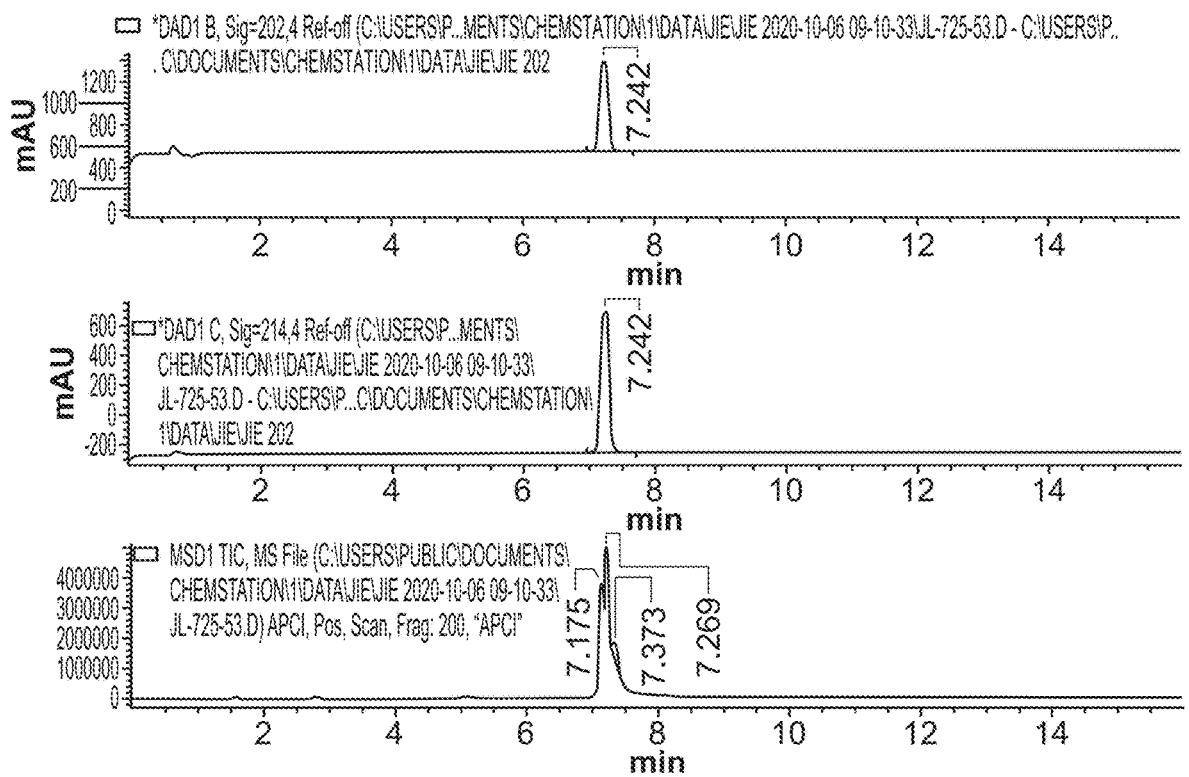
Figure 27F:
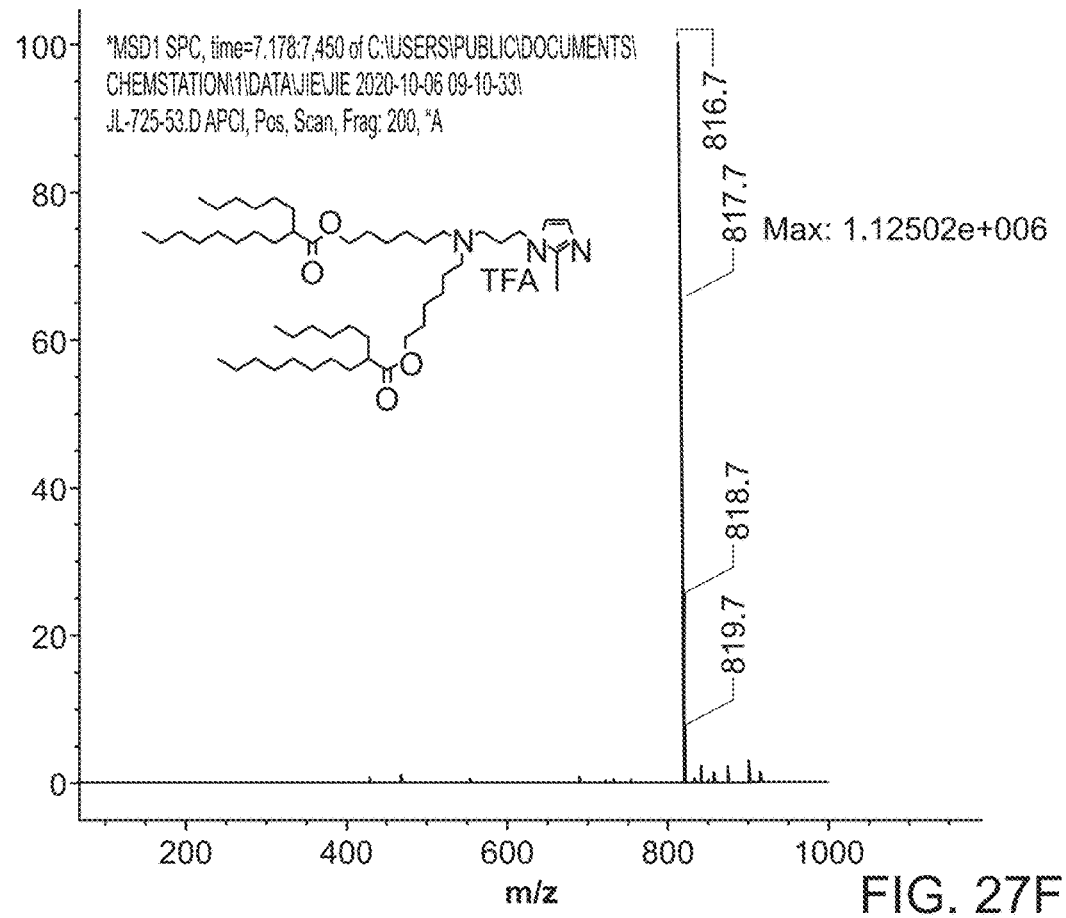

Characterization of Lipid 10a-26 was performed by LC-MS. FIG. 27A-C shows characterization of Lipid 10a-26. FIG. 27A shows the proton NMR observed for Lipid 10a-26. FIG. 27B is a representative LC/MS trace for Lipid 10a-26 with total ion and UV chromatograms shown.

40.2 Synthesis of Lipid 22-S14

40.2.1 Synthesis of 2-(tetradecylthio)ethan-1-ol

To a mixture of 2-sulfanylethanol (5.40 g, 69.11 mmol, 4.82 mL, 0.871 eq) in acetonitrile (200 mL) was added 1-Bromotetradecane (22 g, 79.34 mmol, 23.66 mL, 1 eq) and potassium carbonate (17.55 g, 126.95 mmol, 1.6 eq) at 25° C. The reaction mixture was warmed to 40° C. and stirred for 12 hr. TLC (ethyl acetate/petroleum ether=25/1, $R_f$=0.3, stained by I2) showed the starting material was consumed completely and a new main spot was generated. The reaction mixture was filtered and the filter cake was washed with acetonitrile (50 mL) and then the filtrate was concentrated under vacuum to get a residue which was purified by column on silica gel (ethyl acetate/petroleum ether=1/100 to 1/25) to afford 2-(tetradecylthio)ethan-1-ol (14 g, yield 64.28%) as a white solid.

Figure 28A:
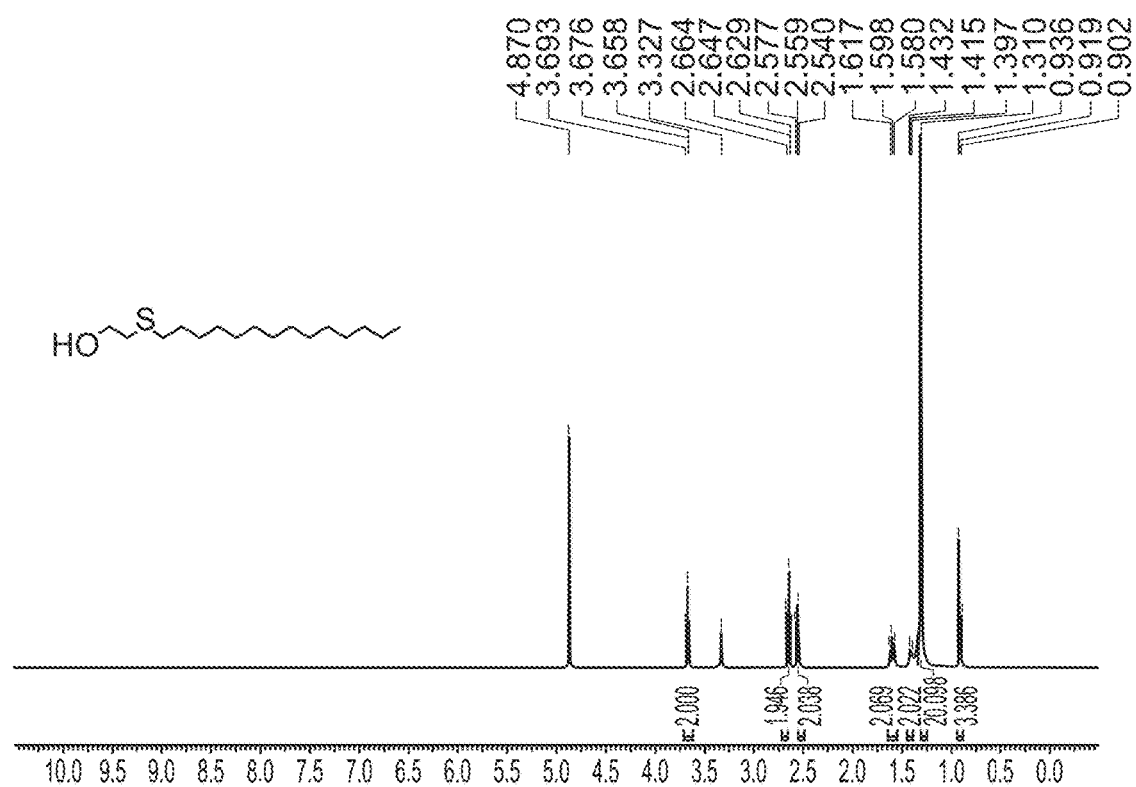
FIGS. 28A-28C depict molecular characterization of Lipid 22-S14 and its synthetic intermediates.
Figure 28B:
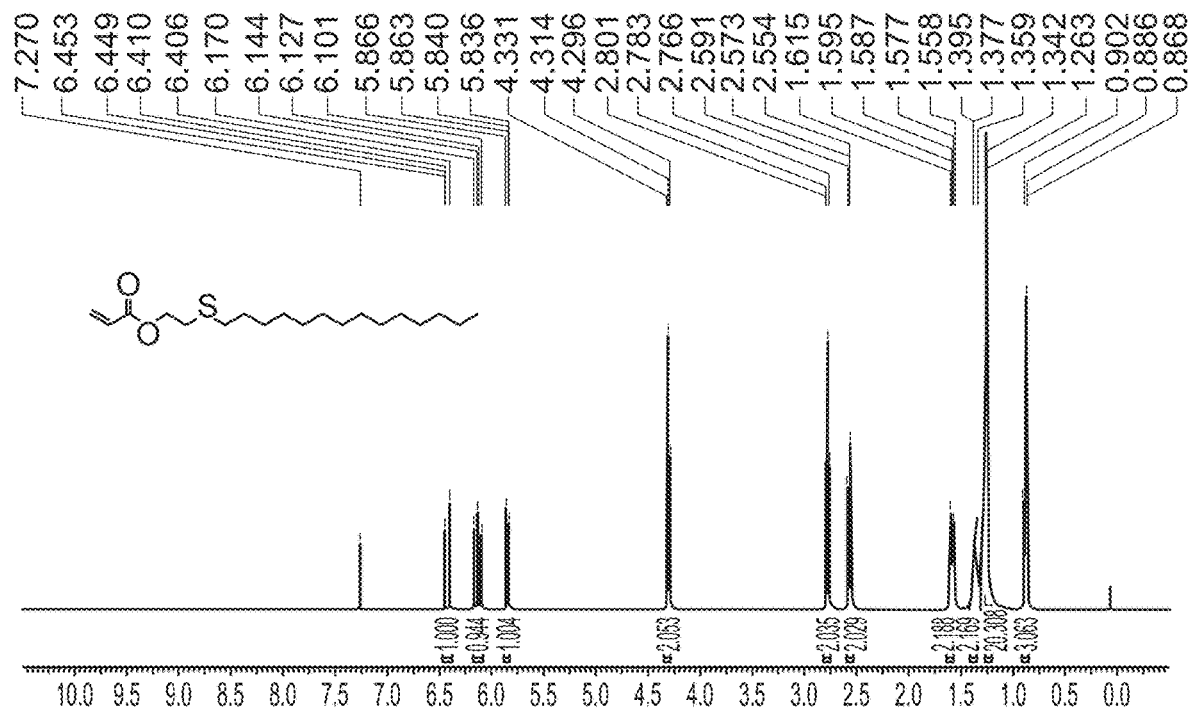
Figure 28C:
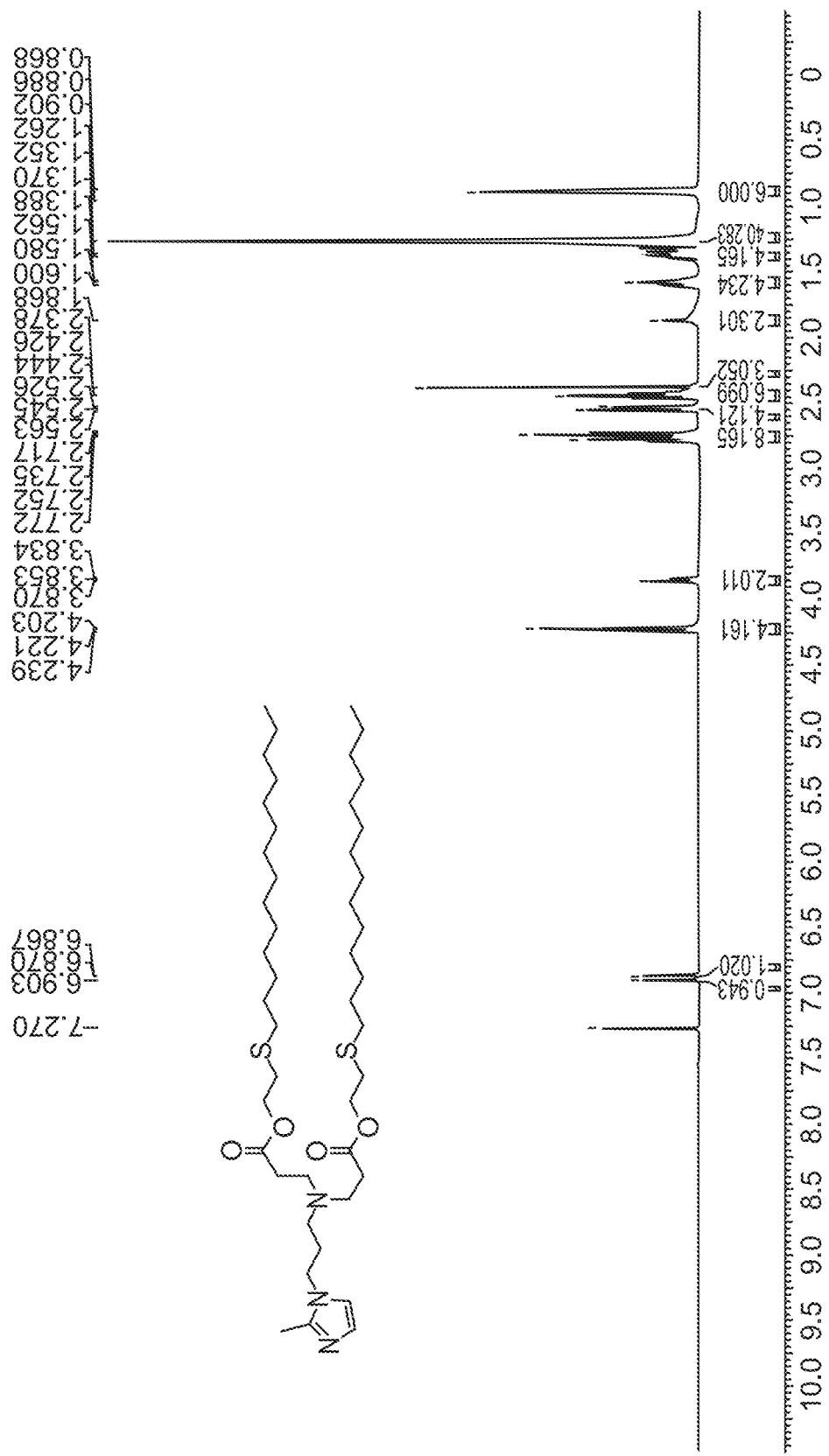

$^1$H NMR (ET36387-45-P1A, 400 MHz, CHLOROFORM-d) δ 0.87-0.91 (m, 3H) 1.27 (s, 20H) 1.35-1.43 (m, 2H) 1.53-1.64 (m, 2H) 2.16 (br s, 1H) 2.49-2.56 (m, 2H) 2.74 (t, J=5.93 Hz, 2H) 3.72 (br d, J=4.89 Hz, 2H). FIG. 28 shows corresponding Nuclear Magnetic Resonance (NMR) spectrum.

40.2.2 Synthesis of 2-(tetradecylthio)ethyl acrylate

To a solution of 2-(tetradecylthio)ethan-1-ol (14 g, 51.00 mmol, 1 eq) in dichloromethane (240 mL) was added triethylamine (7.74 g, 76.50 mmol, 10.65 mL, 1.5 eq) and prop-2-enoyl chloride (5.54 g, 61.20 mmol, 4.99 mL, 1.2 eq) dropwise at 0° C. under nitrogen. The reaction mixture was warmed to 25° C. and stirred for 12 hr. TLC (ethyl acetate/petroleum ether=25/1, Rf=0.5, stained by 12) showed the starting material was consumed completely and a new main spot was generated. The reaction solution was concentrated under vacuum to get crude which was purified by column on silica gel (ethyl acetate/petroleum ether=1/100 to 1/25) to afford 2-(tetradecylthio)ethyl acrylate (12 g, yield 71.61%) as a colorless oil.

Figure 29:
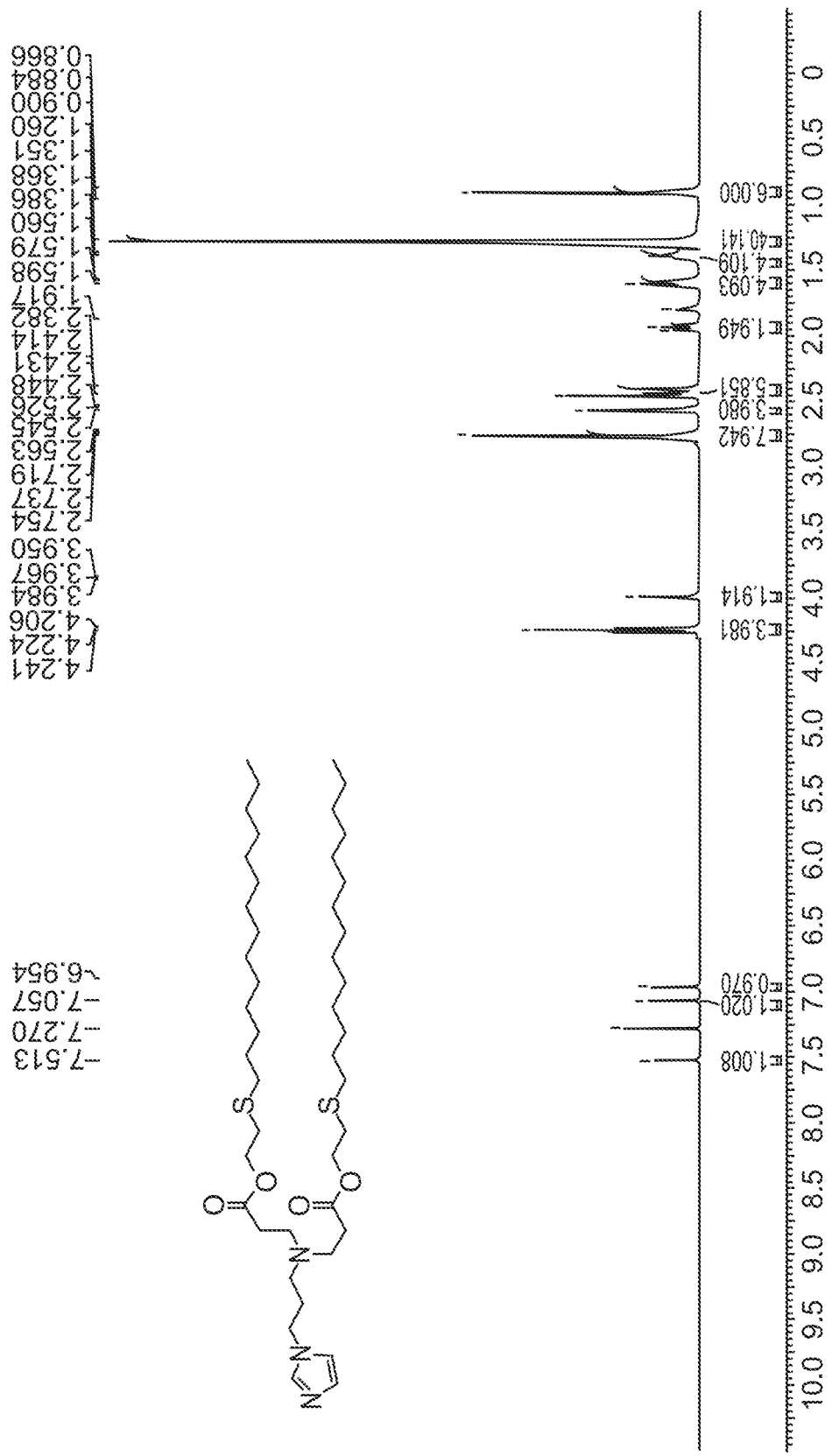
FIG. 29 depicts the NMR spectrum of bis(2-(tetradecylthio)ethyl) 3,3'-((3-(1H-imidazol-1-yl)propyl)azanediyl)dipropionate (Lipid 93-S14).

$^1$H NMR (ET36387-49-P1A, 400 MHz, CHLOROFORM-d) δ 0.85-0.93 (m, 3H) 1.26 (s, 19H) 1.35-1.43 (m, 2H) 1.53-1.65 (m, 2H) 2.53-2.62 (m, 2H) 2.79 (t, J=7.03 Hz, 2H) 4.32 (t, J=7.03 Hz, 2H) 5.86 (dd, J=10.39, 1.47 Hz, 1H) 6.09-6.19 (m, 1H) 6.43 (dd, J=17.30, 1.41 Hz, 1H). FIG. 29 shows corresponding Nuclear Magnetic Resonance (NMR) spectrum.

40.2.3 Synthesis of bis(2-(tetradecylthio)ethyl) 3,3'-((3-(2-methyl-1H-imidazol-1-yl)propyl)azanediyl)dipropionate (Lipid 22-S14)

A flask was charged with 3-(2-methyl-1H-imidazol-1-yl)propan-1-amine (300 mg, 2.16 mmol) and 2-(tetradecylthio)ethyl acrylate (1.70 g, 5.17 mmol). The neat reaction mixture was heated to 80° C. and stirred for 48 hr. TLC (ethyl acetate, $R_f$=0.3, stained by 12, one drop ammonium hydroxide added) showed the starting material was consumed completely and a new main spot was formed. The reaction mixture was diluted with dichloromethane (4 mL) and purified by column on silica gel (petroleum ether/ethyl acetate=3/1 to 0/1, 0.1% ammonium hydroxide added) to get bis(2-(tetradecylthio)ethyl) 3,3'-((3-(2-methyl-1H-imidazol-1-yl)propyl)azanediyl)dipropionate (501 mg, yield 29.1%) as colorless oil.

Figure 30A:
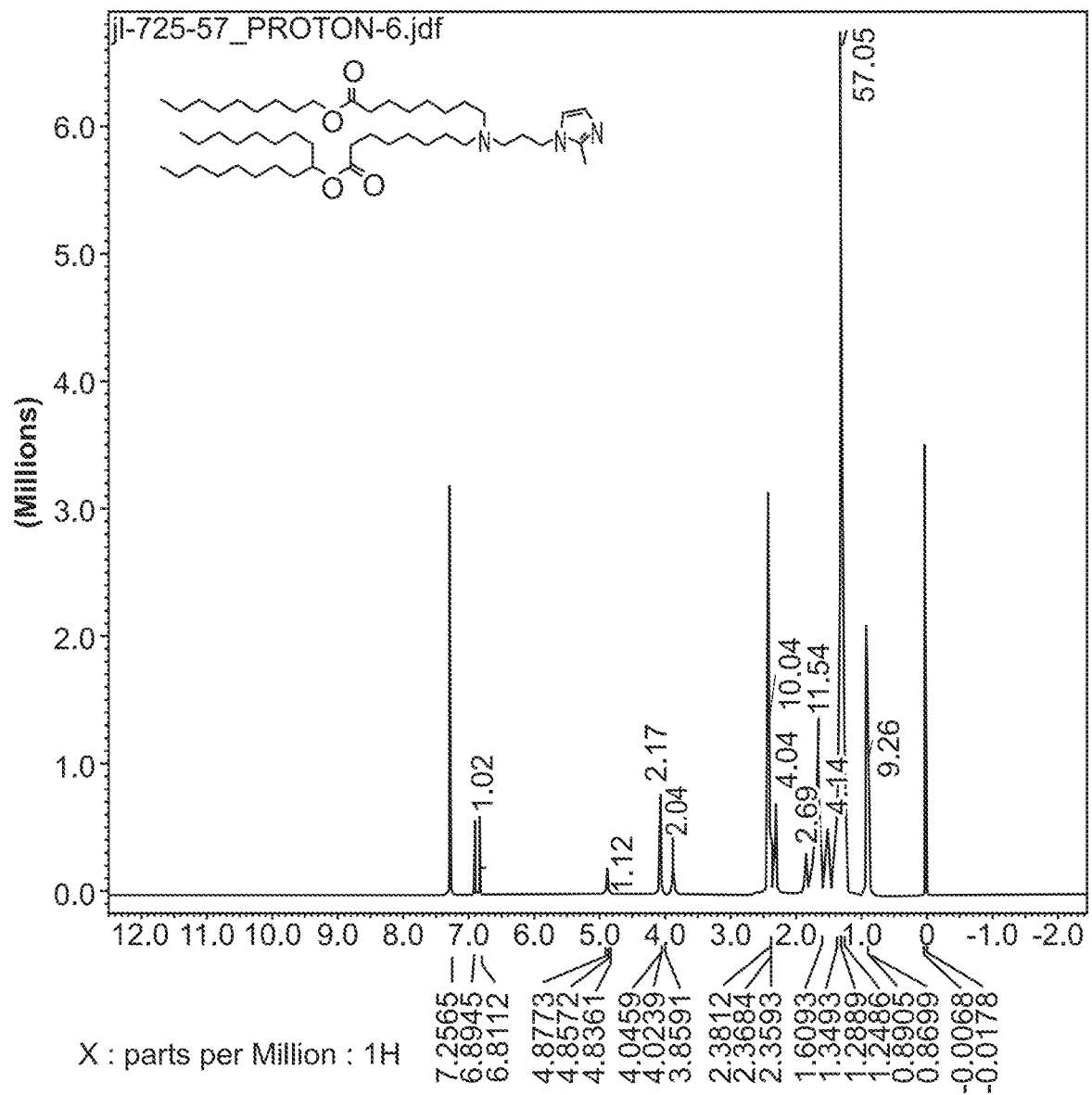
FIGS. 30A-30C depict molecular characterization of heptadecan-9-yl 8-((3-(2-methyl-1H-imidazol-1-yl)propyl)(8-(nonyloxy)-8-oxooctyl)amino)octanoate (Lipid 10a-54).
Figure 30B:
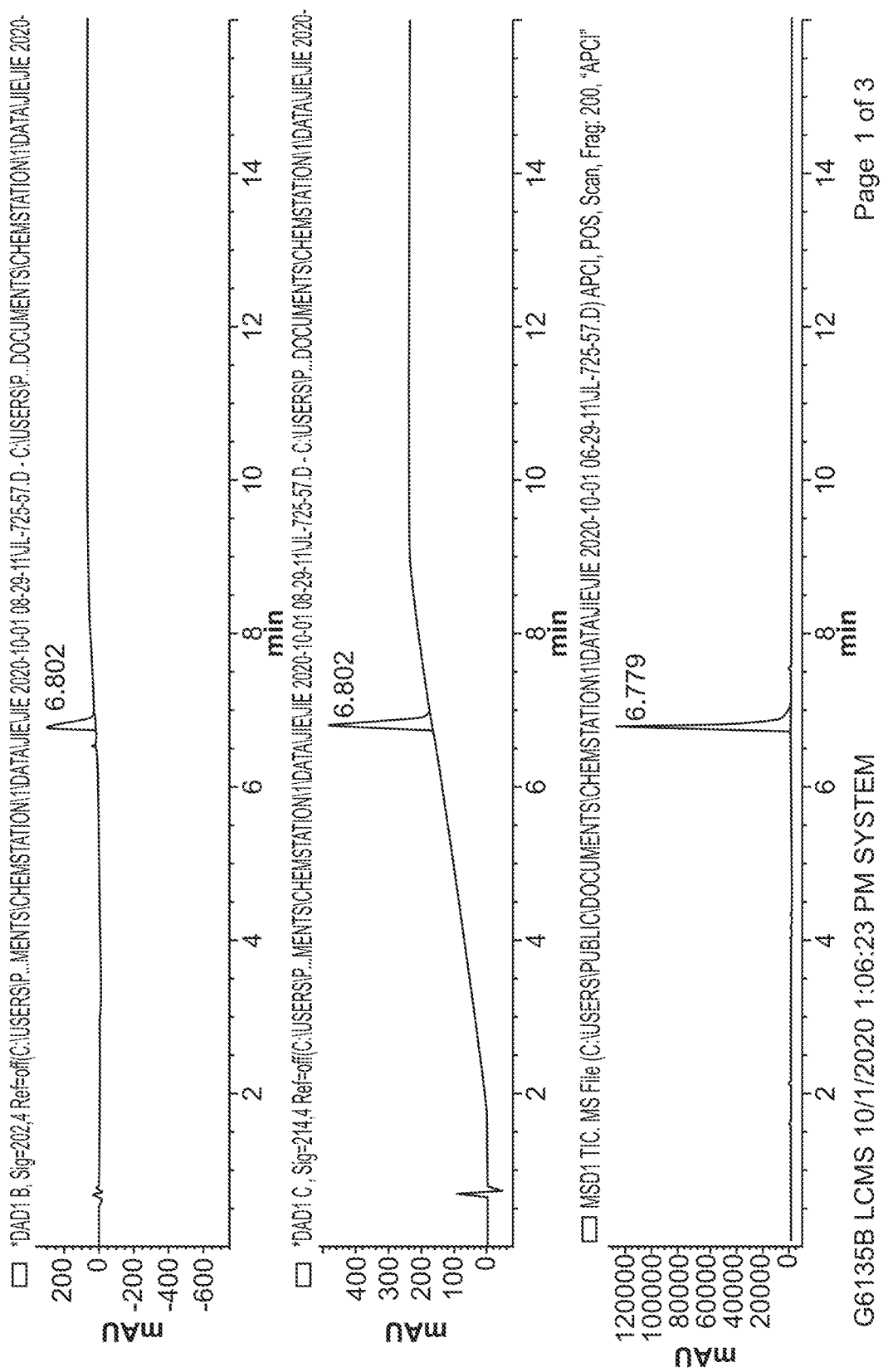
Figure 30C:
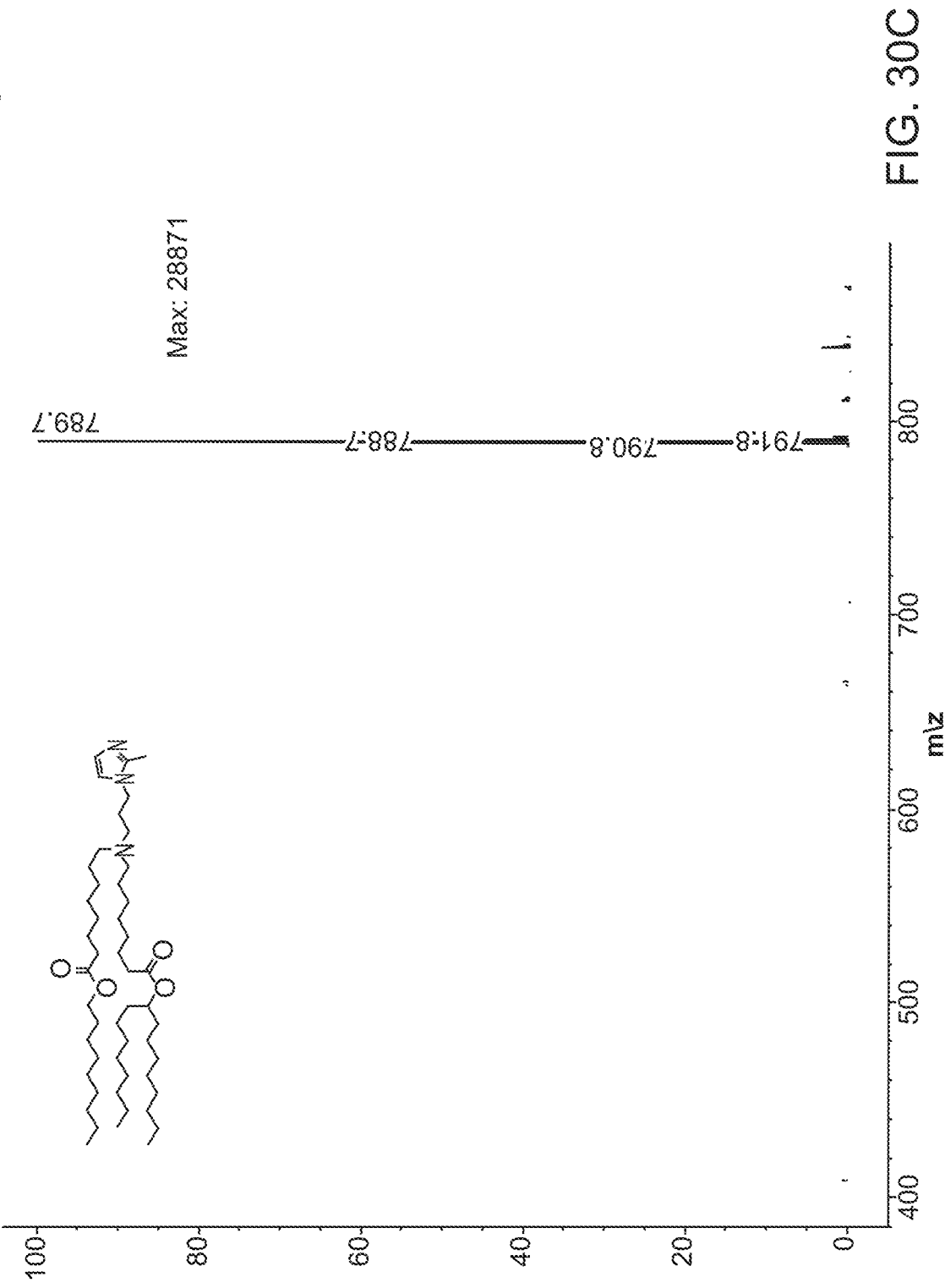

$^1$H NMR (ET36387-51-P1A, 400 MHz, CHLOROFORM-d) δ 0.87 (t, J=6.73 Hz, 6H) 1.25 (s, 40H) 1.33-1.40 (m, 4H) 1.52-1.61 (m, 4H) 1.81-1.90 (m, 2H) 2.36 (s, 3H) 2.39-2.46 (m, 6H) 2.53 (t, J=7.39 Hz, 4H) 2.70-2.78 (m, 8H) 3.84 (t, J=7.17 Hz, 2H) 4.21 (t, J=6.95 Hz, 4H) 6.85 (s, 1H) 6.89 (s, 1H). FIG. 30 shows corresponding Nuclear Magnetic Resonance (NMR) spectrum.

40.3 Synthesis of bis(2-(tetradecylthio)ethyl) 3,3'-((3-(1H-imidazol-1-yl)propyl)azanediyl)dipropionate (Lipid 93-S14)

A flask was charged with 3-(1H-imidazol-1-yl)propan-1-amine (300 mg, 2.40 mmol, 1 eq) and 2-(tetradecylthio)ethyl acrylate (1.89 g, 5.75 mmol, 2.4 eq). The neat reaction mixture was heated to 80° C. and stirred for 48 hr. TLC (ethyl acetate, $R_f$=0.3, stained by 12, one drop ammonium hydroxide added) showed the starting material was consumed completely and a new main spot was formed. The reaction mixture was diluted with dichloromethane (4 mL) and purified by column on silica gel (petroleum ether/ethyl acetate=1/20-0/100, 0.1% ammonium hydroxide added) to get bis(2-(tetradecylthio)ethyl) 3,3'-((3-(1H-imidazol-1-yl)propyl)azanediyl)dipropionate (512 mg, yield 27.22%) as colorless oil.

Figure 31A:
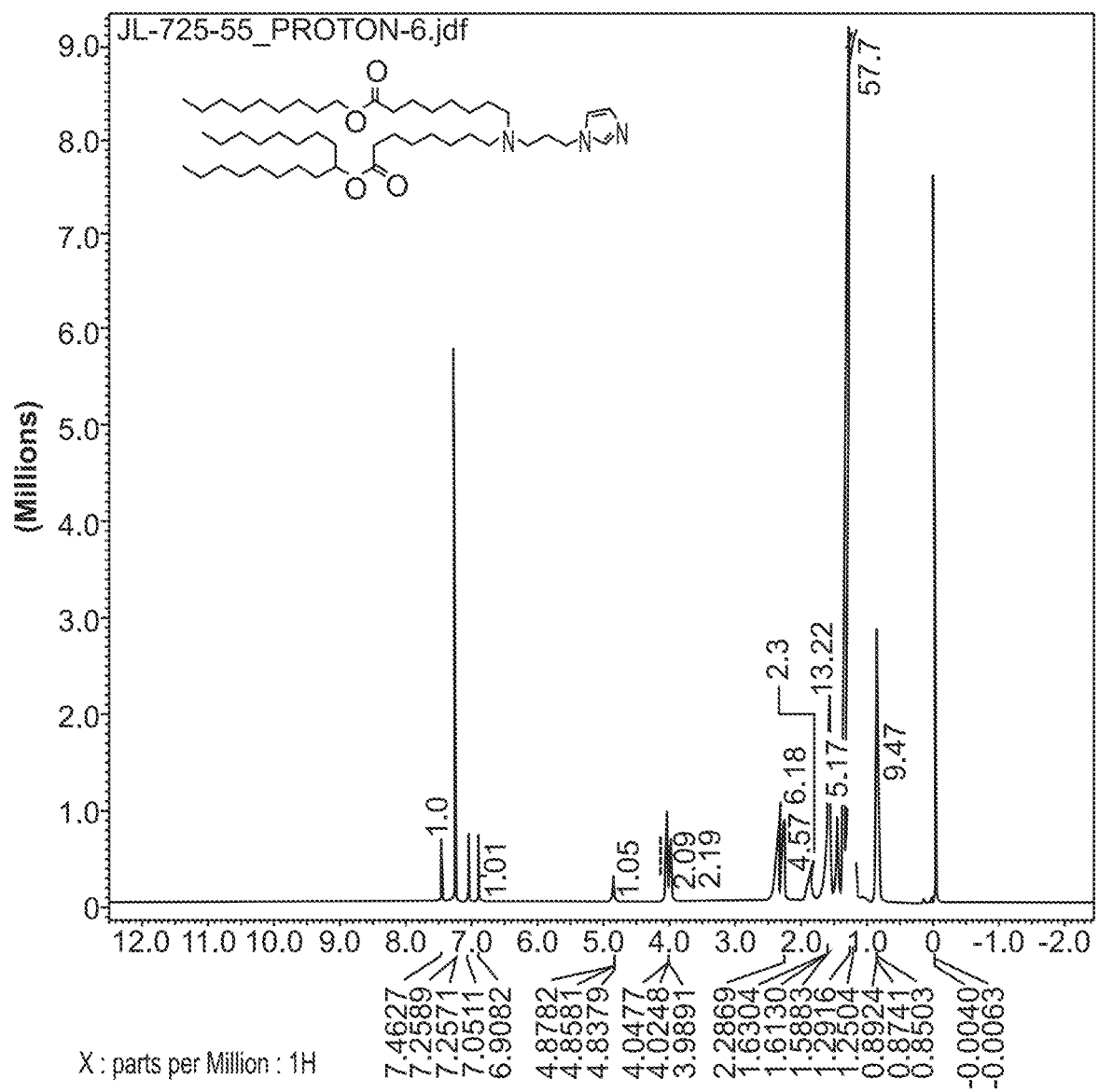
Figure 31C:
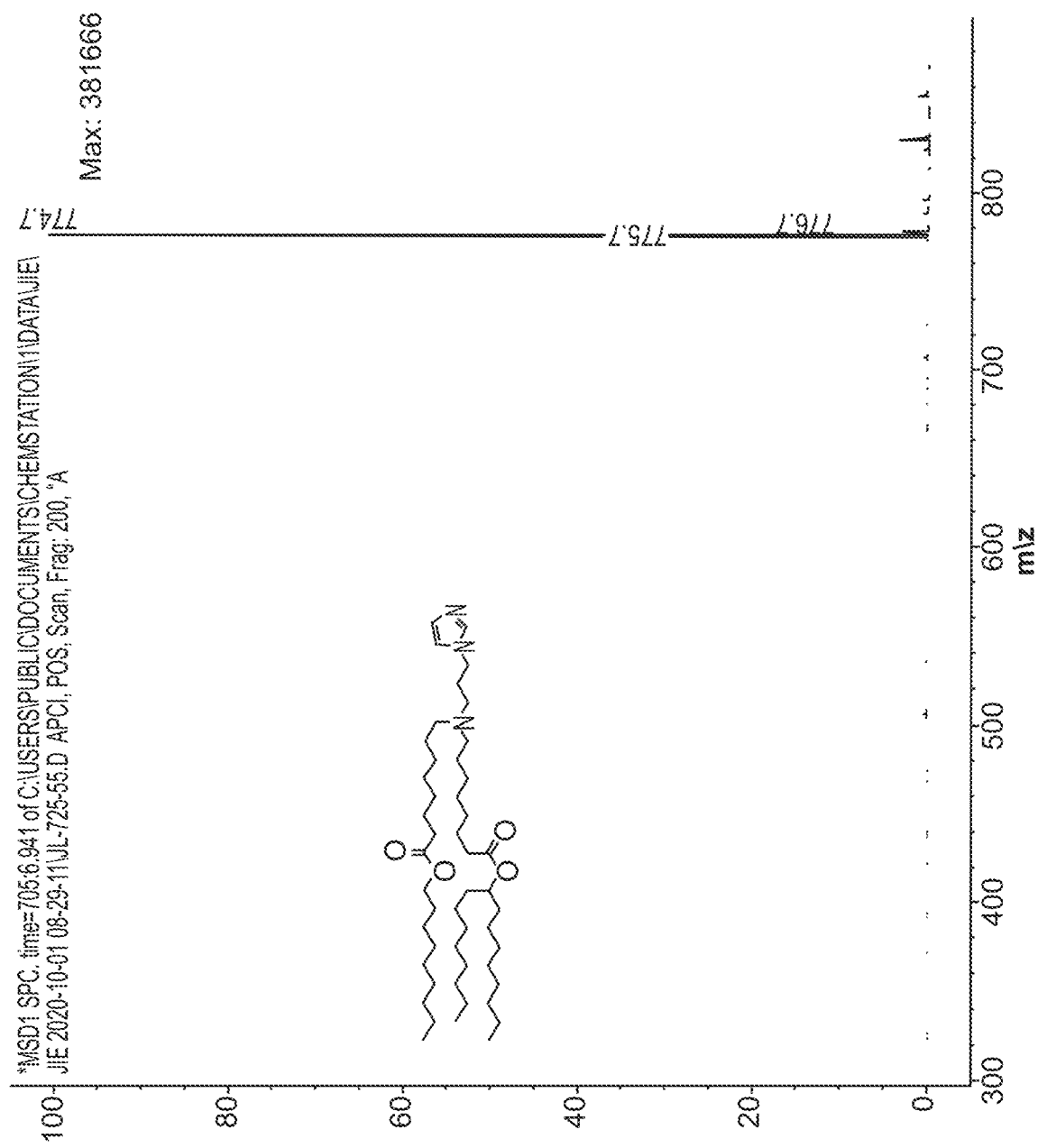

$^1$H NMR (ET36387-54-P1A, 400 MHz, CHLOROFORM-d) δ 0.89 (t, J=6.84 Hz, 6H) 1.26 (s, 40H) 1.34-1.41 (m, 4H) 1.58 (br t, J=7.50 Hz, 4H) 1.92 (t, J=6.62 Hz, 2H) 2.36-2.46 (m, 6H) 2.55 (t, J=7.50 Hz, 4H) 2.75 (q, J=6.84 Hz, 8H) 3.97 (t, J=6.95 Hz, 2H) 4.23 (t, J=6.95 Hz, 4H) 6.95 (s, 1H) 7.06 (s, 1H) 7.51 (s, 1H). FIG. 31 shows corresponding Nuclear Magnetic Resonance (NMR) spectrum.

40.4 Synthesis of heptadecan-9-yl 8-((3-(2-methyl-1H-imidazol-1-yl)propyl)(8-(nonyloxy)-8-oxooctyl)amino)octanoate (Lipid 10a-54)

40.4.1 Synthesis of nonyl 8-bromooctanoate (3)

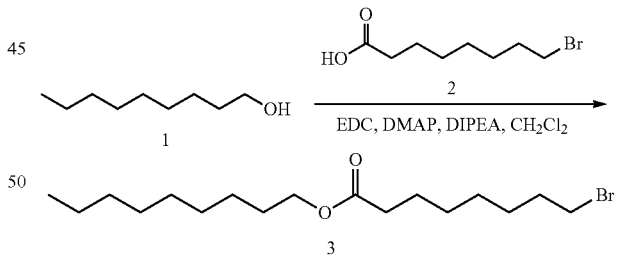

To a mixture of 8-bromooctanoic acid (2) (18.6 g, 83.18 mmol) and nonan-1-ol (1) (10 g, 69.32 mmol) in $CH_2Cl_2$ (500 mL) was added DMAP (1.7 g, 13.86 mmol), DIPEA (48 mL, 277.3 mmol) and EDC (16 g, 83.18 mmol). The reaction was stirred at room temperature overnight. After concentration of the reaction mixture, the crude residue was dissolved in ethyl acetate (500 mL), washed with 1N HCl, sat. $NaHCO_3$, water and Brine. The organic layer was dried over anhydrous $Na_2SO_4$. The solvent was evaporated and the crude residue was purified by flash chromatography ($SiO_2$: Hexane=100% to 30% of EtOAc in Hexane) and colorless oil product 3 was obtained (9 g, 37%).

40.4.2 Synthesis of heptadecan-9-yl 8-bromooctanoate (5)

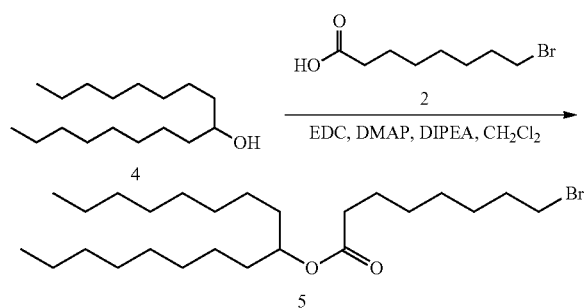

To a mixture of 8-bromooctanoic acid (2) (10 g, 44.82 mmol) and heptadecan-9-ol (4) (9.6 g, 37.35 mmol) in CH$_2$Cl$_2$ (300 mL) was added DMAP (900 mg, 7.48 mmol), DIPEA (26 mL, 149.7 mmol) and EDC (10.7 g, 56.03 mmol). The reaction was stirred at room temperature overnight. After concentration of the reaction mixture, the crude residue was dissolved in ethyl acetate (300 mL), washed with 1N HCl, sat. NaHCO$_3$, water and Brine. The organic layer was dried over anhydrous Na$_2$SO$_4$. The solvent was evaporated and the crude residue was purified by flash chromatography (SiO$_2$: Hexane=100% to 30% of EtOAc in Hexane) and colorless oil product 5 was obtained (5 g, 29%).

$^1$H NMR (300 MHz, CDCl$_3$): δ ppm 4.86 (m, 1H), 3.39 (t, J=7.0 Hz, 2H), 2.27 (t, J=7.6 Hz, 2H), 1.84 (m, 2H), 1.62 (m, 2H), 1.5-1.4 (m, 8H), 1.35-1.2 (m, 26H) 0.87 (t, J=6.7 Hz, 6H).

40.4.3 Synthesis of heptadecan-9-yl 8-((3-(2-methyl-1H-imidazol-1-yl)propyl)amino)octanoate (7)

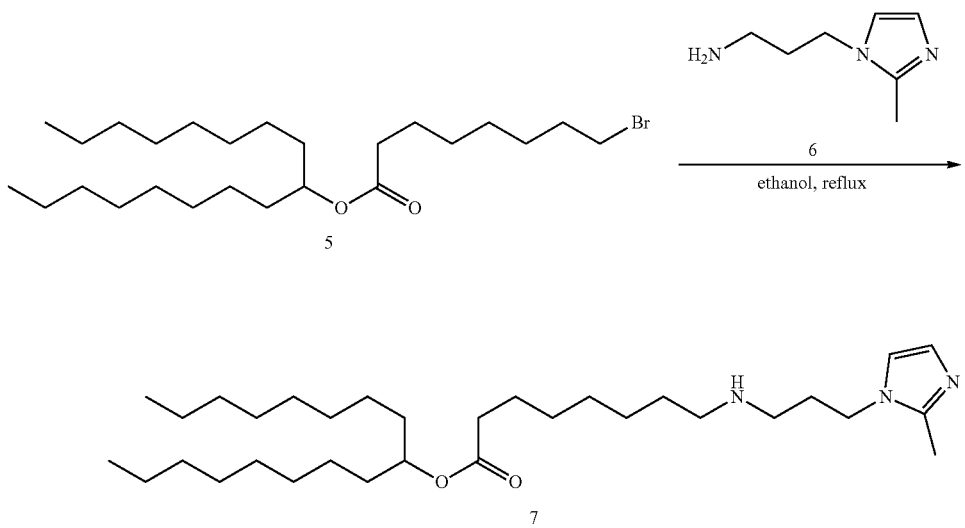

In a 100 mL round bottom flask connected with condenser, heptadecan-9-yl 8-bromooctanoate (5) (860 mg, 1.868 mmol) and 3-(2-methyl-1H-imidazol-1-yl)propan-1-amine (6) (1.3 g, 9.339 mmol) were mixed in ethanol (10 mL). The reaction mixture was heated to reflux overnight. MS (APCI) showed the expected product. The mixture was cooled to room temperature and concentrated. The crude residue was purified by flash chromatography (SiO$_2$: CH$_2$Cl$_2$=100% to 10% of methanol+1% NH$_4$OH in CH$_2$Cl$_2$) and colorless oil product 7 was obtained (665 mg, 69%).

40.4.4 Synthesis of heptadecan-9-yl 8-((3-(2-methyl-1H-imidazol-1-yl)propyl)(8-(nonyloxy)-8-oxooctyl)amino)octanoate (Lipid 10a-54)

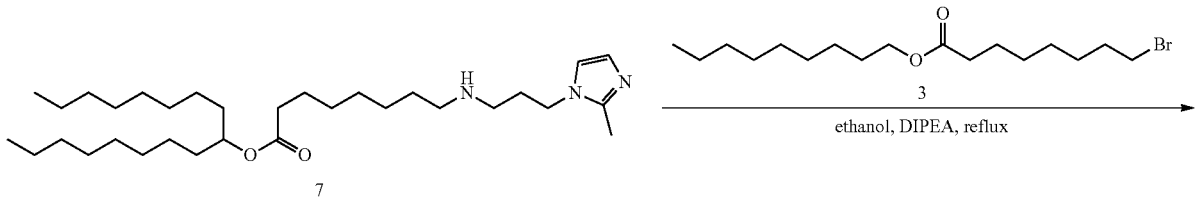

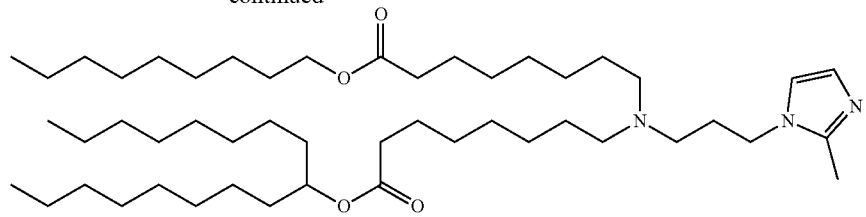

In a 100 mL round bottom flask connected with condenser, heptadecan-9-yl 8-((3-(2-methyl-1H-imidazol-1-yl)propyl)amino)octanoate (7) (665 mg, 1.279 mmol) and nonyl 8-bromooctanoate (3) (536 mg, 1.535 mmol) were mixed in ethanol (10 mL), then DIPEA (0.55 mL, 3.198 mmol) was added. The reaction mixture was heated to reflux overnight. Both MS (APCI) and TLC (10% MeOH+1% NH$_4$OH in CH$_2$Cl$_2$) showed the product and some unreacted starting material. The mixture was cooled to room temperature and concentrated. The crude residue was purified by flash chromatography (SiO$_2$: CH$_2$Cl$_2$=100% to 10% of methanol+1% NH$_4$OH in CH$_2$Cl$_2$) and colorless oil was obtained (170 mg, 17%).

40.5 Synthesis of heptadecan-9-yl 8-((3-(1H-imidazol-1-yl)propyl)(8-(nonyloxy)-8-oxooctyl)amino)octanoate (Lipid 10a-53)

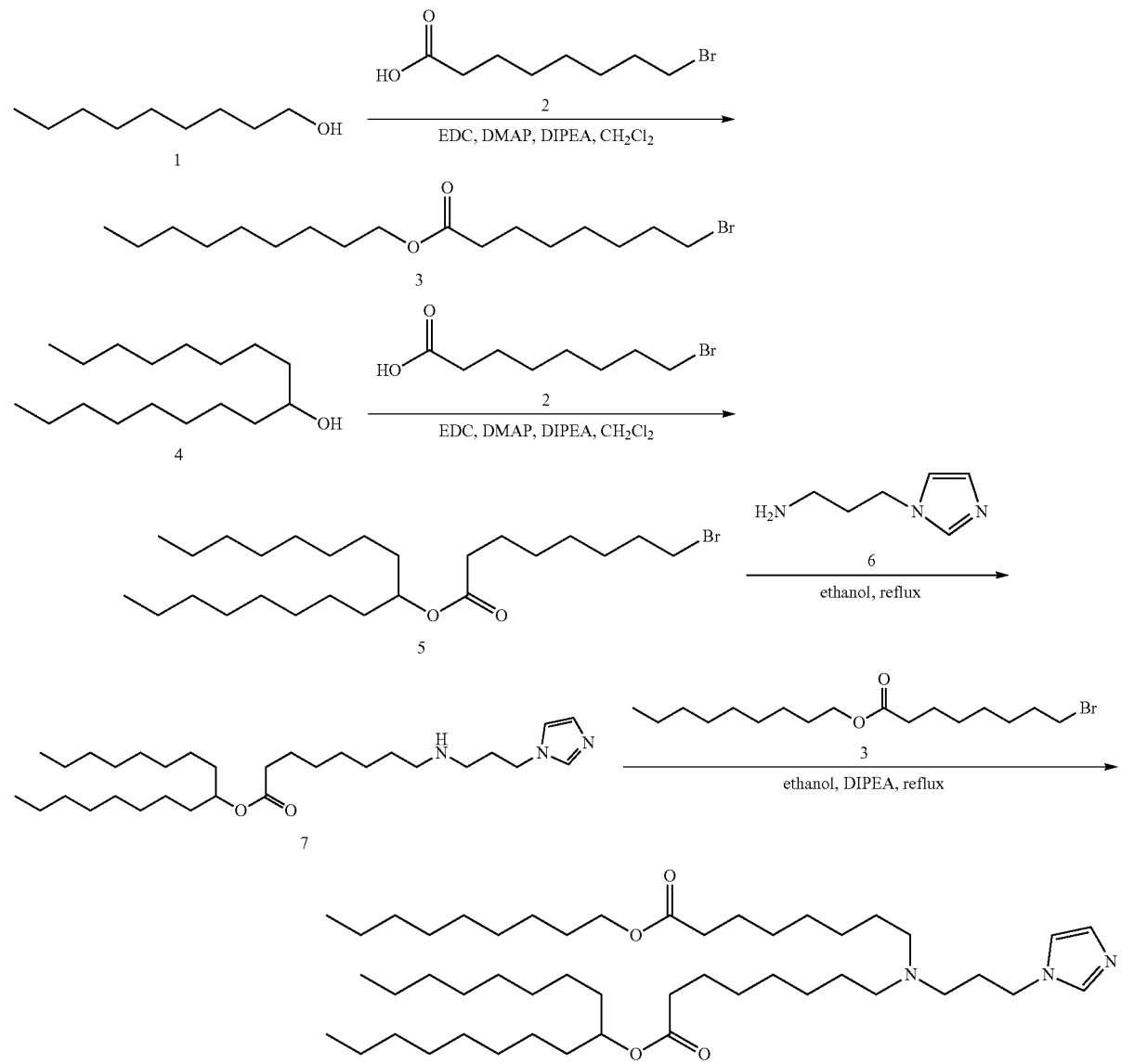

Lipid 10a-53 is synthesized according to the scheme above. Reaction conditions are identical to Lipid 10a-54 with the exception of 3-(1H-imidazol-1-yl)propan-1-amine as the imidazole amine.

40.6 Synthesis of Heptadecan-9-yl 8-((3-(1H-imidazol-1-yl)propyl)(8-(nonyloxy)-8-oxooctyl)amino)octanoate (Lipid 10a-45)

40.6.1 Synthesis of heptadecan-9-yl 8-bromooctanoate (3)

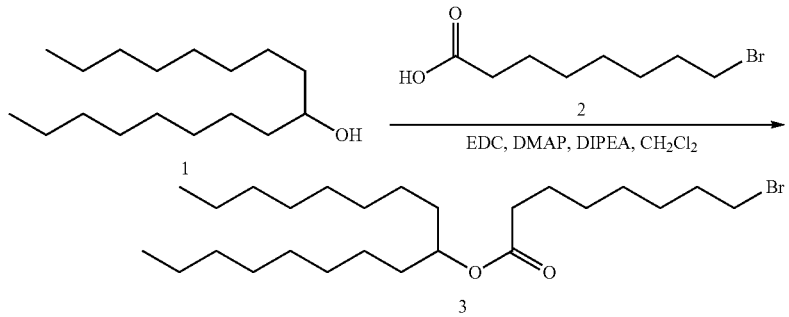

To a mixture of 8-bromooctanoic acid (2) (10 g, 44.82 mmol) and heptadecan-9-ol (1) (9.6 g, 37.35 mmol) in CH$_2$Cl$_2$ (300 mL) was added DMAP (900 mg, 7.48 mmol), DIPEA (26 mL, 149.7 mmol) and EDC (10.7 g, 56.03 mmol). The reaction was stirred at room temperature overnight. After concentration of the reaction mixture, the crude residue was dissolved in ethyl acetate (300 mL), washed with 1N HCl, sat. NaHCO$_3$, water and Brine. The organic layer was dried over anhydrous Na$_2$SO$_4$. The solvent was evaporated and the crude residue was purified by flash chromatography (SiO$_2$: Hexane=100% to 30% of EtOAc in Hexane) and colorless oil product 3 was obtained (5 g, 29%).

$^1$H NMR (300 MHz, CDCl$_3$): δ ppm 4.86 (m, 1H), 3.39 (t, J=7.0 Hz, 2H), 2.27 (t, J=7.6 Hz, 2H), 1.84 (m, 2H), 1.62 (m, 2H), 1.5-1.4 (m, 8H), 1.35-1.2 (m, 26H) 0.87 (t, J=6.7 Hz, 6H).

40.6.2 Synthesis of heptadecan-9-yl 8-((3-(1H-imidazol-1-yl)propyl)amino)octanoate (6)

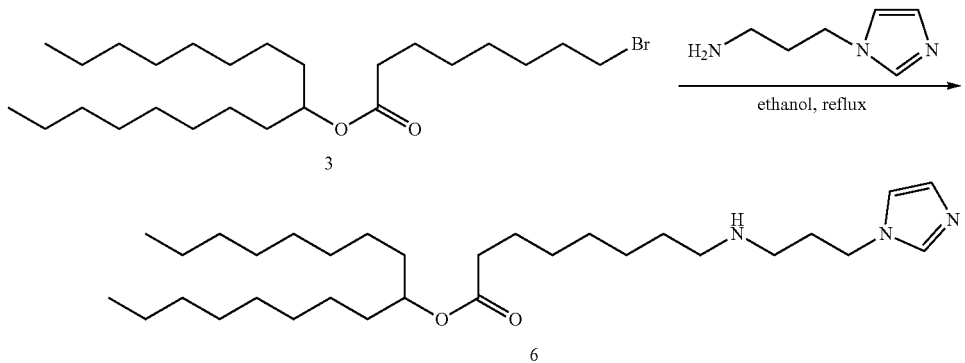

In a 100 mL round bottom flask connected with condenser, heptadecan-9-yl 8-bromooctanoate (3) (1 g, 2.167 mmol) and 3-(1H-imidazol-1-yl)propan-1-amine (4) (1.3 mL, 10.83 mmol) were mixed in ethanol (10 mL). The reaction mixture was heated to reflux overnight. MS (APCI) showed the expected product. The mixture was cooled to room temperature and concentrated. The crude residue was purified by flash chromatography (SiO$_2$: CH$_2$Cl$_2$=100% to 10% of methanol+1% NH$_4$OH in CH$_2$Cl$_2$) and colorless oil product 6 was obtained (498 mg, 45%).

$^1$H NMR (300 MHz, CDCl$_3$): δ ppm 7.47 (s, 1H), 7.04 (s, 1H), 6.91 (s, 1H), 4.85 (m, 1H), 4.03 (t, J=7.0 Hz, 2H), 2.56 (dd, J=14.5, 7.4 Hz, 4H), 2.27 (t, J=7.4 Hz, 2H), 1.92 (m, 2H), 1.60 (m, 2H), 1.48 (m, 6H), 1.30-1.20 (m, 31H), 0.86 (t, J=6.6 Hz, 6H). MS (APCI+): 506.4 (M+1).

40.6.3 Synthesis of nonyl 8-bromooctanoate (9)

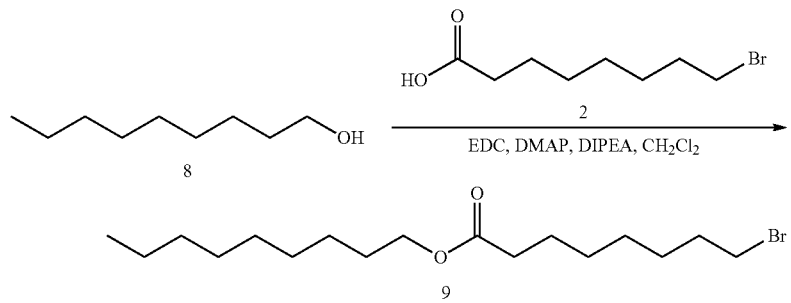

To a mixture of 8-bromooctanoic acid (2) (18.6 g, 83.18 mmol) and nonan-1-ol (8) (10 g, 69.32 mmol) in $CH_2Cl_2$ (500 mL) was added DMAP (1.7 g, 13.86 mmol), DIPEA (48 mL, 277.3 mmol) and EDC (16 g, 83.18 mmol). The reaction was stirred at room temperature overnight. After concentration of the reaction mixture, the crude residue was dissolved in ethyl acetate (500 mL), washed with 1N HCl, sat. $NaHCO_3$, water and Brine. The organic layer was dried over anhydrous $Na_2SO_4$. The solvent was evaporated and the crude residue was purified by flash chromatography ($SiO_2$: Hexane=100% to 30% of EtOAc in Hexane) and colorless oil product 9 was obtained (9 g, 37%).

$^1$H NMR (300 MHz, $CDCl_3$): δ ppm 4.05 (t, J=7.0 Hz, 2H), 3.39 (t, J=7.0 Hz, 2H), 2.29 (t, J=7.6 Hz, 2H), 1.84 (m, 2H), 1.62-1.56 (m, 6H), 1.40-1.20 (m, 16H), 0.87 (t, J=6.7 Hz, 3H).

40.6.4 Synthesis of heptadecan-9-yl 8-((3-(1H-imidazol-1-yl)propyl)(8-(nonyloxy)-8-oxooctyl)amino)octanoate

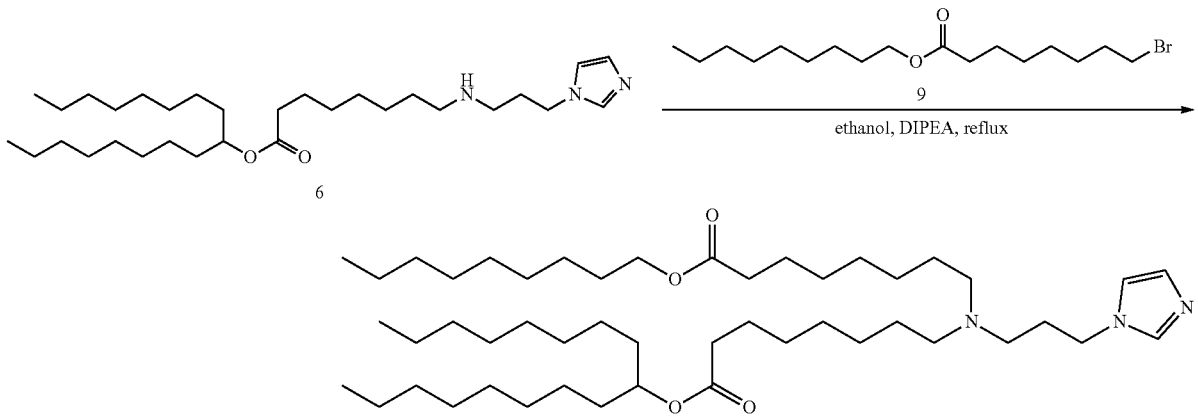

In a 100 mL round bottom flask connected with condenser, heptadecan-9-yl 8-((3-(1H-imidazol-1-yl)propyl)amino)octanoate (6) (242 mg, 0.478 mmol) and nonyl 8-bromooctanoate 9 (200 mg, 0.574 mmol) were mixed in ethanol (10 mL), then DIPEA (0.2 mL, 1.196 mmol) was added. The reaction mixture was heated to reflux overnight. Both MS (APCI) and TLC (10% MeOH+1% NH4OH in CH2Cl2) showed the product and some unreacted starting material. The mixture was cooled to room temperature and concentrated. The crude residue was purified by flash chromatography ($SiO_2$: $CH_2Cl_2$=100% to 10% of methanol+1% $NH_4OH$ in $CH_2Cl_2$) and colorless oil was obtained (35 mg, 10%).

$^1$H NMR (300 MHz, $CDCl_3$): δ ppm 7.46 (s, 1H), 7.05 (s, 1H), 6.90 (s, 1H), 4.85 (m, 1H), 4.04 (t, J=6.6 Hz, 2H), 4.01 (t, J=6.6 Hz, 2H), 2.38 (m, 6H), 2.27 (t, J=3.8 Hz, 4H), 1.89 (m, 2H), 1.60-1.58 (m, 12H), 1.48 (m, 6H), 1.30-1.20 (m, 47H), 0.87 (t, J=7.1 Hz, 9H). MS (APCI+): 774.6 (M+1).

40.7 Synthesis of Heptadecan-9-yl 8-((3-(2-methyl-1H-imidazol-1-yl)propyl)(8-(nonyloxy)-8-oxooctyl)amino)octanoate (Lipid 10a-46)
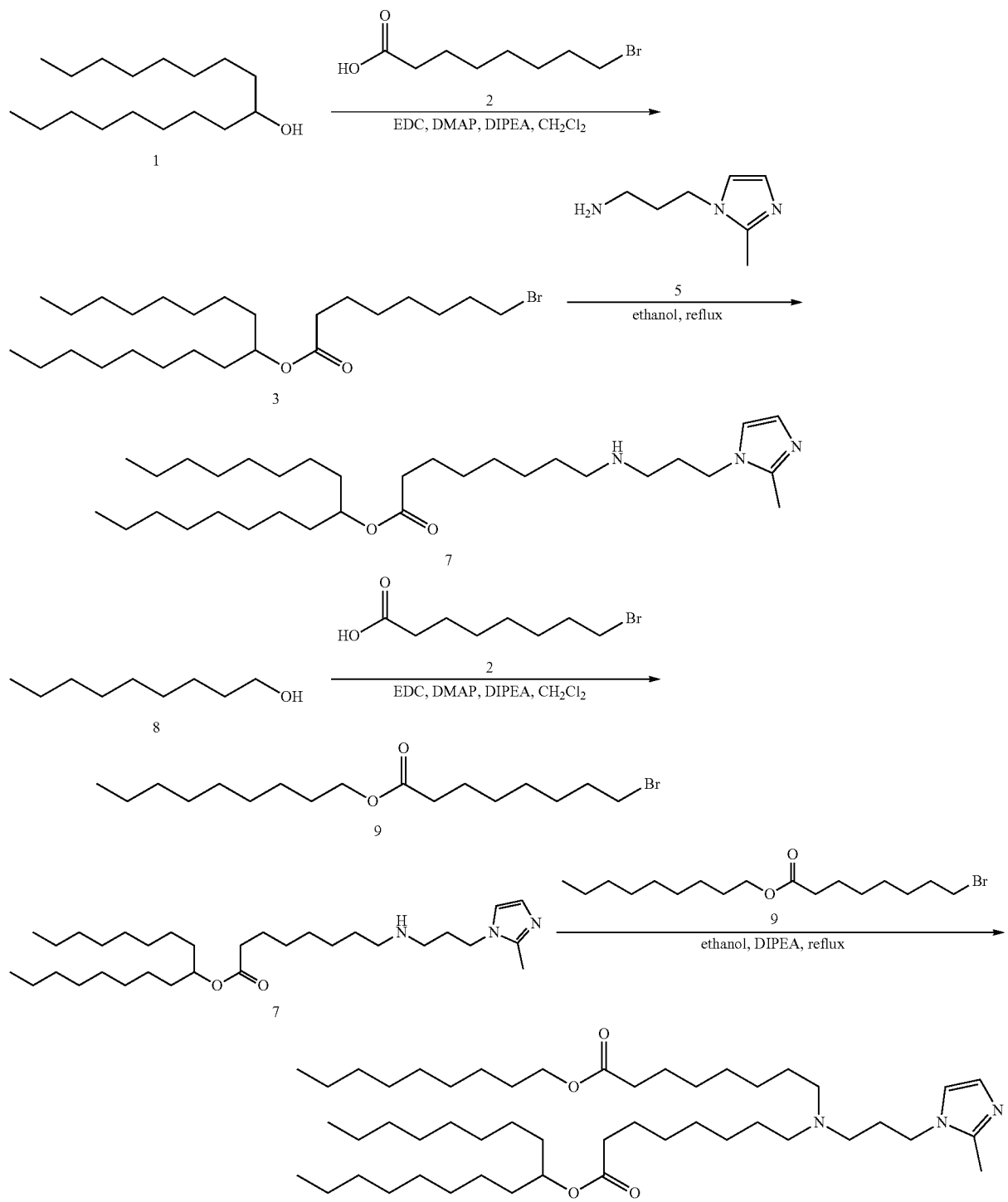
Lipid 10a-46 is synthesized according to the scheme above. Reaction conditions are identical to Lipid 10a-45 with the exception of 3-(2-Methyl-1H-imidazol-1-yl)propan-1-amine as the imidazole amine.
$^1$H NMR (300 MHz, CDCl$_3$): δ ppm 6.89 (s, 1H), 6.81 (s, 1H), 4.86 (m, 1H), 4.04 (t, J=6.8 Hz, 2H), 3.85 (t, J=7.4 Hz, 2H), 2.38-2.36 (m, 9H), 2.28 (m, 4H), 1.82 (m, 2H), 1.72-1.56 (m, 12H), 1.48 (m, 4H), 1.30-1.20 (m, 46H), 0.86 (t, J=6.6 Hz, 9H). MS (APCI+): 789.7 (M+1).

40.8 Synthesis of Heptadecan-9-yl 8-((3-(1H-imidazol-1-yl)propyl)(8-oxo-8-(undecan-3-yloxy)octyl)amino)octanoate (Lipid 10a-137)

40.8.1 Synthesis of heptadecan-9-yl 8-bromooctanoate (3)

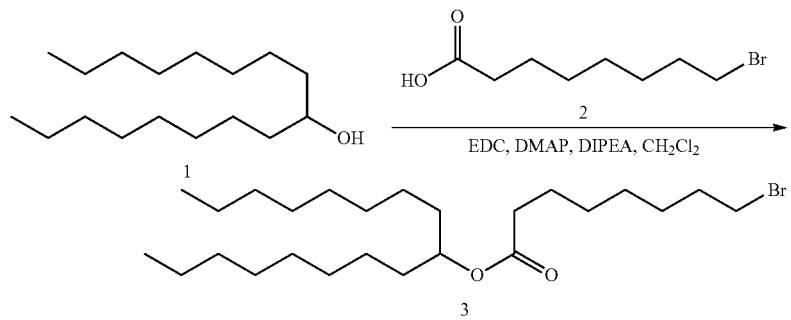

To a mixture of 8-bromooctanoic acid (2) (10 g, 44.82 mmol) and heptadecan-9-ol (1) (9.6 g, 37.35 mmol) in CH2Cl2 (300 mL) was added DMAP (900 mg, 7.48 mmol), DIPEA (26 mL, 149.7 mmol) and EDC (10.7 g, 56.03 mmol). The reaction was stirred at room temperature overnight. After concentration of the reaction mixture, the crude residue was dissolved in ethyl acetate (300 mL), washed with 1N HCl, sat. NaHCO$_3$, water and Brine. The organic layer was dried over anhydrous Na$_2$SO$_4$. The solvent was evaporated and the crude residue was purified by flash chromatography (SiO$_2$: Hexane=100% to 30% of EtOAc in Hexane) and colorless oil product 3 was obtained (5 g, 29%).

1H NMR (300 MHz, CDCl$_3$): δ ppm 4.86 (m, 1H), 3.39 (t, J=7.0 Hz, 2H), 2.27 (t, J=7.6 Hz, 2H), 1.84 (m, 2H), 1.62 (m, 2H), 1.5-1.4 (m, 8H), 1.35-1.2 (m, 26H) 0.87 (t, J=6.7 Hz, 6H).

40.8.2 Synthesis of heptadecan-9-yl 8-((3-(H-imidazol-1-yl)propyl)amino)octanoate (6)

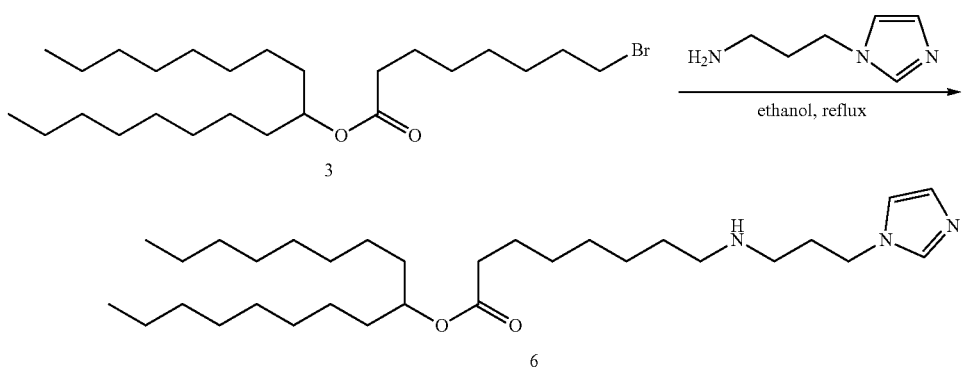

In a 100 mL round bottom flask connected with condenser, heptadecan-9-yl 8-bromooctanoate (3) (1 g, 2.167 mmol) and 3-(1H-imidazol-1-yl)propan-1-amine (4) (1.3 mL, 10.83 mmol) were mixed in ethanol (10 mL). The reaction mixture was heated to reflux overnight. MS (APCI) showed the expected product. The mixture was cooled to room temperature and concentrated. The crude residue was purified by flash chromatography (SiO$_2$: CH$_2$Cl$_2$=100% to 10% of methanol+1% NH$_4$OH in CH$_2$Cl$_2$) and colorless oil product 6 was obtained (498 mg, 45%).

$^1$H NMR (300 MHz, CDCl$_3$): δ ppm 7.47 (s, 1H), 7.04 (s, 1H), 6.91 (s, 1H), 4.85 (m, 1H), 4.03 (t, J=7.0 Hz, 2H), 2.56 (dd, J=14.5, 7.4 Hz, 4H), 2.27 (t, J=7.4 Hz, 2H), 1.92 (m, 2H), 1.60 (m, 2H), 1.48 (m, 6H), 1.30-1.20 (m, 31H), 0.86 (t, J=6.6 Hz, 6H). MS (APCI+): 506.4 (M+1).

40.8.3 Synthesis of undecan-3-ol (11)

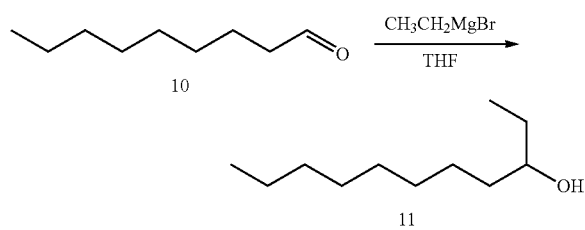

To a mixture of nonanal (10) (5 g, 35.2 mmol), in anhydrous THF (100 mL) at 0° C. ice-water bath was dropwise added ethylmagnesium bromide (47 mL, 42.2 mmol, 0.9M in THF). The reaction was stirred at room temperature overnight. The reaction was quenched with ice and diluted with ethyl acetate (500 mL), washed with 1N HCl, sat. NaHCO$_3$, water and Brine. The organic layer was dried over anhydrous Na$_2$SO$_4$. The solvent was evaporated and the crude residue was purified by flash chromatography (SiO$_2$: Hexane=100% to 50% of EtOAc in Hexane) and colorless oil product 11 was obtained (4 g, 66%).

$^1$H NMR (300 MHz, CDCl$_3$): δ ppm 3.52 (m, 1H), 1.56-1.3 (m, 4H), 1.3-1.20 (m, 12H), 0.93 (t, J=7.4 Hz, 3H), 0.87 (t, J=7.4 Hz, 3H).

40.8.4 Synthesis of undecan-3-yl 8-bromooctanoate (12)

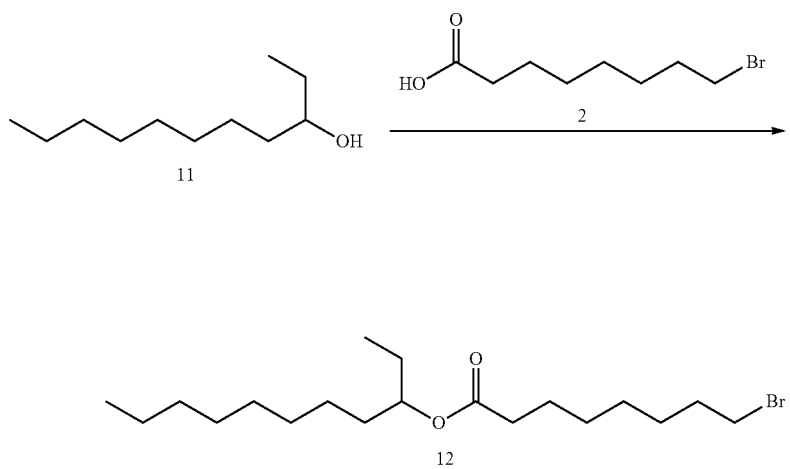

To a mixture of 8-bromooctanoic acid (2) (6.2 g, 27.9 mmol) and undecan-3-ol (11) (4 g, 23.2 mmol) in CH$_2$Cl$_2$ (100 mL) was added DMAP (567.2 mg, 4.64 mmol), DIPEA (16.2 mL, 92.9 mmol) and EDC (6.7 g, 34.8 mmol). The reaction was stirred at room temperature overnight. After concentration of the reaction mixture, the crude residue was dissolved in ethyl acetate (500 mL), washed with 1N HCl, sat. NaHCO$_3$, water and Brine. The organic layer was dried over anhydrous Na$_2$SO$_4$. The solvent was evaporated and the crude residue was purified by flash chromatography (SiO$_2$: Hexane=100% to 30% of EtOAc in Hexane) and colorless oil product 12 was obtained (7.3 g, 83%).

$^1$H NMR (300 MHz, CDCl$_3$): δ ppm 4.80 (m, 1H), 3.39 (t, J=6.8 Hz, 2H), 2.28 (t, J=7.7 Hz, 2H), 1.84 (m, 2H), 1.6-1.35 (m, 8H), 1.35-1.2 (m, 16H), 0.87 (t, J=7.4 Hz, 6H).

40.8.4 Synthesis of heptadecan-9-yl 8-((3-(1H-imidazol-1-yl)propyl)(8-(nonyloxy)-8-oxooctyl)amino)octanoate

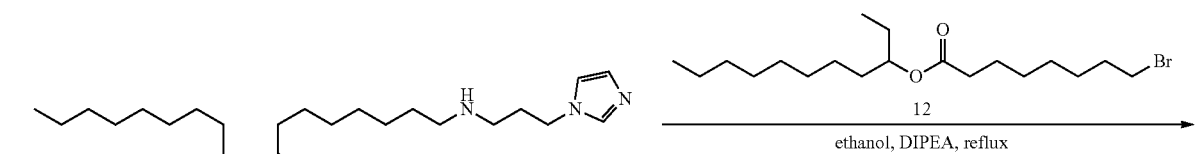

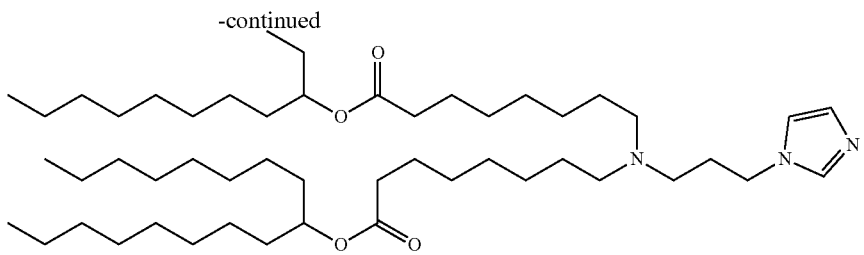

In a 100 mL round bottom flask connected with condenser, heptadecan-9-yl 8-((3-(1H-imidazol-1-yl)propyl)amino)octanoate (6) (242 mg, 0.478 mmol) and undecan-3-yl 8-bromooctanoate (12) (200 mg, 0.574 mmol) were mixed in ethanol (10 mL), then DIPEA (0.2 mL, 1.196 mmol) was added. The reaction mixture was heated to reflux overnight. Both MS (APCI) and TLC (10% MeOH+1% NH$_4$OH in CH$_2$Cl$_2$) showed the product and some unreacted starting material. The mixture was cooled to room temperature and concentrated. The crude residue was purified by flash chromatography (SiO$_2$: CH$_2$Cl$_2$=100% to 10% of methanol+1% NH$_4$OH in CH$_2$Cl$_2$) and colorless oil was obtained (35 mg, 10%).

$^1$H NMR (300 MHz, CDCl$_3$): δ ppm 7.45 (s, 1H), 7.04 (s, 1H), 6.90 (s, 1H), 4.82 (m, 2H), 3.97 (t, J=6.8 Hz, 2H), 2.35 (m, 6H), 2.27 (t, J=3.8 Hz, 4H), 1.89 (m, 2H), 1.60-1.48 (m, 14H), 1.30-1.20 (m, 50H), 0.87 (m, 12H). MS (APCI+): 802.8

40.9 Synthesis of Heptadecan-9-yl 8-((3-(2-methyl-1H-imidazol-1-yl)propyl)(8-(nonyloxy)-8-oxooctyl)amino)octanoate (Lipid 10a-138)

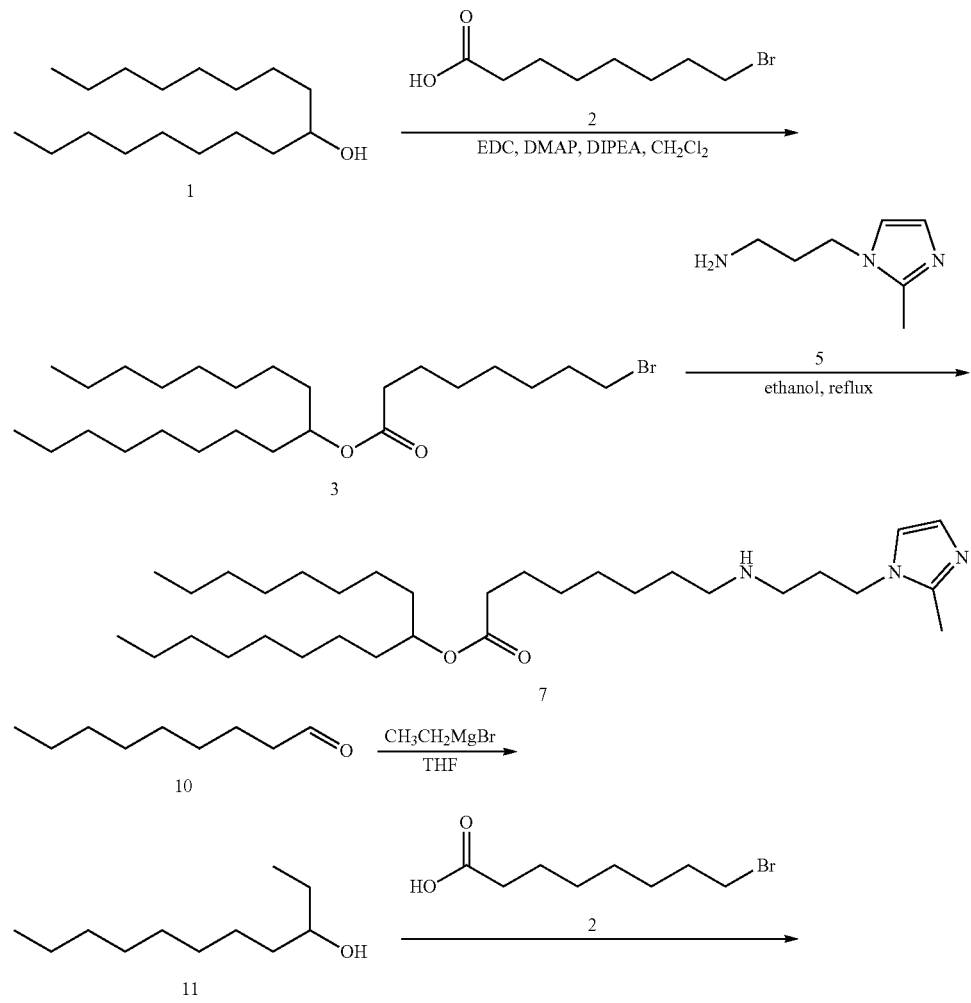

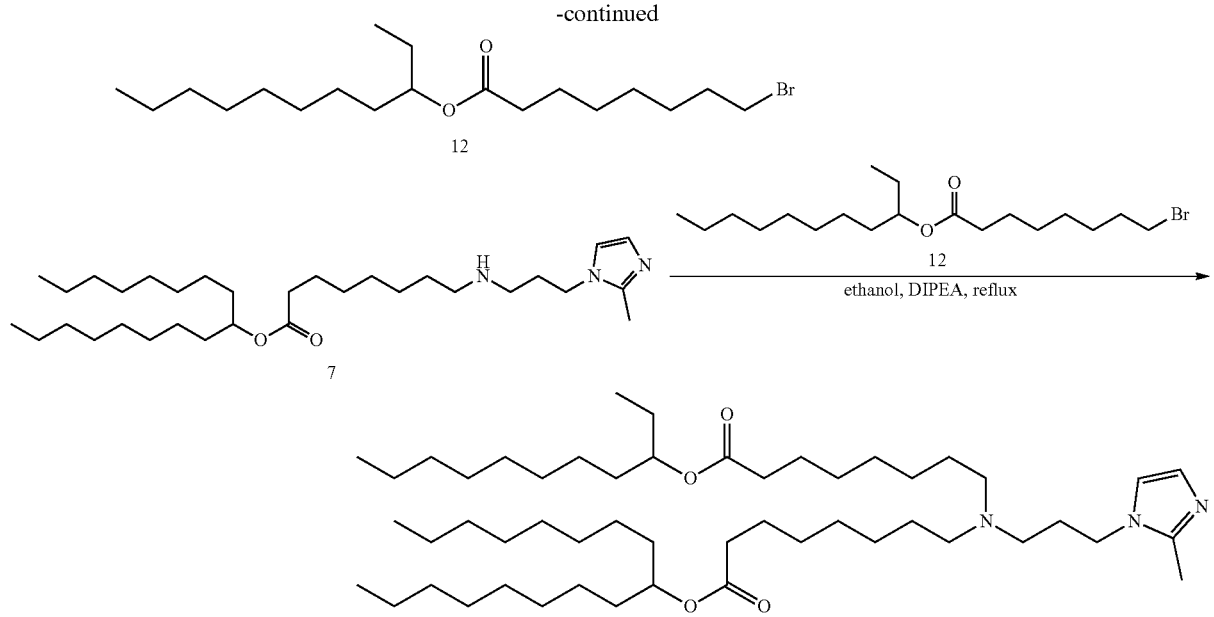

Lipid 10a-138 is synthesized according to the scheme above. Reaction conditions are identical to Lipid 10a-137 with the exception of 3-(2-Methyl-1H-imidazol-1-yl)propan-1-amine as the imidazole amine.

$^1$H NMR (300 MHz, CDCl$_3$): δ ppm 6.89 (s, 1H), 6.81 (s, 1H), 4.82 (m, 2H), 3.86 (t, J=7.1 Hz, 2H), 2.38-2.3 (m, 9H), 2.27 (t, J=3.8 Hz, 4H), 1.84 (m, 2H), 1.60-1.37 (m, 14H), 1.30-1.20 (m, 50H), 0.87 (m, 12H). MS (APCI+): 816.8 (M+1).

40.10 Synthesis of (((2-(2-Methyl-1H-imidazol-1-yl)ethyl)azanediyl)bis(hexane-6,1-diyl) bis(2-hexyldecanoate) (Lipid 10a-139)

40.10.1 Synthesis of 6-bromohexyl 2-hexyldecanoate (3)

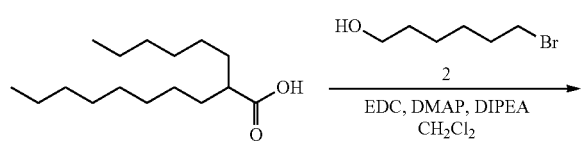

To a mixture of 2-hexyldecanoic acid (1) (102 g, 0.398 mol) and 6-bromo-1-hexanol (2) (60 g, 0.331 mol) in CH$_2$Cl$_2$ (1 L) was added DMAP (8.1 g, 66 mmol), DIPEA (230 mL, 1.325 mol) and EDC (76 g, 0.398 mol). The reaction was stirred at room temperature overnight. After concentration of the reaction mixture, the crude residue was dissolved in ethyl acetate (1 L), washed with 1N HCl, sat. NaHCO$_3$, water and Brine. The organic layer was dried over anhydrous Na$_2$SO$_4$. The solvent was evaporated and the crude residue was purified by flash chromatography (SiO$_2$: Hexane=100% to 30% of EtOAc in Hexane) and colorless oil product 3 was obtained (67 g, 48%).

$^1$H NMR (300 MHz, CDCl$_3$): δ ppm 4.06 (t, J=6.6 Hz, 2H), 3.4 (t, J=6.8 Hz, 2H), 2.3 (m, 1H), 1.86 (m, 2H), 1.64 (m, 2H), 1.5-1.4 (m, 2H), 1.35-1.2 (m, 26H) 0.87 (t, J=6.7 Hz, 6H)

40.10.2 Synthesis of 6-((3-(1H-imidazol-1-yl)butyl)amino)hexyl 2-hexyldecanoate (7a)

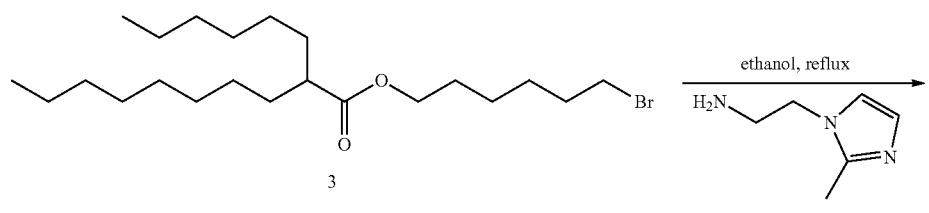

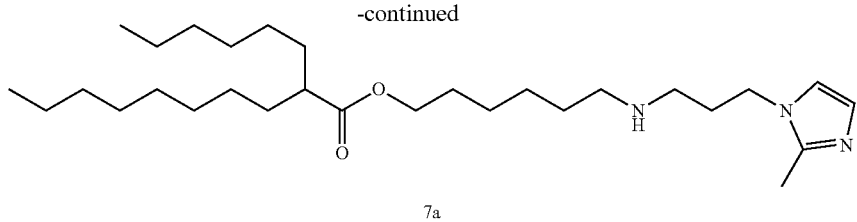

7a

In a 100 mL round bottom flask connected with condenser, 6-bromohexyl 2-hexyldecanoate (3) (1.2 g, 2.87 mmol) and 3-(1H-imidazol-1-yl)butan-1-amine (7) (2 g, 14.37 mmol) were mixed in ethanol (20 mL). The reaction mixture was heated to reflux overnight. MS (APCI) showed the expected product. The mixture was cooled to room temperature and concentrated. The crude residue was purified by flash chromatography (SiO$_2$: CH$_2$Cl$_2$=100% to 10% of methanol+1% NH$_4$OH in CH$_2$Cl$_2$) and colorless oil product 7a was obtained (626 mg, 46%).

$^1$H NMR (300 MHz, CDCl$_3$): δ ppm 7.51 (s, 1H), 7.05 (s, 1H), 6.93 (s, 1H), 4.35 (m, 1H), 4.04 (t, J=6.6 Hz, 2H), 2.6-2.4 (m, 4H), 2.29 (m, 1H), 1.94 (td, J=14, 6.8 Hz, 2H), 1.64-1.56 (m, 4H), 1.47 (s, 3H), 1.42-1.20 (m, 29H), 0.86 (m, 6H). MS (APCI+): 478.8 (M+1)

40.10.2 Synthesis of ((2-(2 Methyl-1H-imidazol-1-yl)ethyl)azanediyl)bis(hexane-6,1-diyl) bis(2-hexyldecanoate)

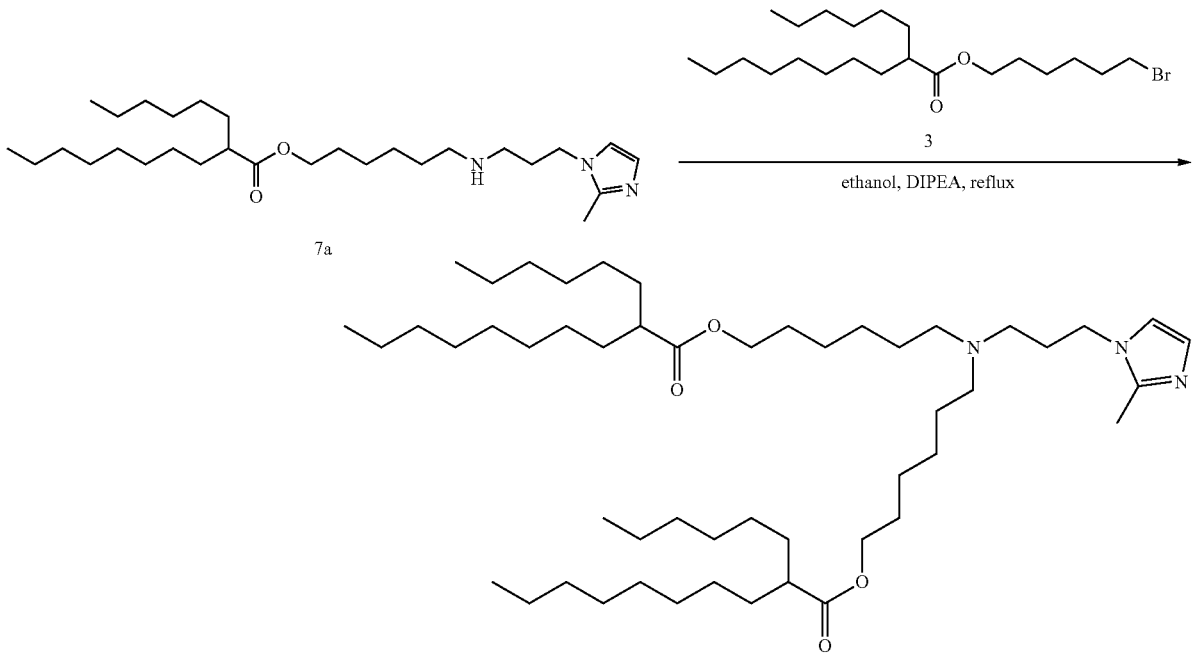

In a 100 mL round bottom flask connected with condenser, 6-((3-(1H-imidazol-1-yl)butyl)amino)hexyl 2-hexyldecanoate (7a) (626 mg, 1.31 mmol) and 6-bromohexyl 2-hexyldecanoate (3) (550 mg, 1.31 mmol) were mixed in ethanol (20 mL), then DIPEA (0.6 mL, 3.276 mmol) was added. The reaction mixture was heated to reflux overnight. Both MS (APCI) and TLC (10% MeOH+1% NH$_4$OH in CH$_2$Cl$_2$) showed the product and unreacted starting material 7a. The mixture was cooled to room temperature and concentrated. The crude residue was purified by flash chromatography (SiO$_2$: CH$_2$Cl$_2$=100% to 10% of methanol+1% NH$_4$OH in CH$_2$Cl$_2$) and the obtained product was further purified by C18 reverse phase chromatography (H$_2$O=95% to 0.1% TFA in CH$_3$CN=100%) colorless oil (TFA salt) was obtained (140 mg, 13%).

$^1$H-NMR (300 MHz, CDCl$_3$): δ 6.87 (s, 1H), 6.83 (s, 1H), 4.05 (t, J=6.7 Hz, 4H), 3.84 (t, J=6.9 Hz, 2H), 2.66 (t, J=6.9 Hz, 2H), 2.45-2.20 (m, 6H), 2.37 (s, 3H), 1.65-1.50 (m, 8H), 1.5-1.1 (m, 56H), 0.86 (t, J=6.5 Hz, 12H). MS (APCI+): 802.6 (M+1).

40.11 Synthesis of (((1-Methyl-1H-imidazol-2-yl)methyl)azanediyl)bis(hexane-6,1-diyl) bis(2-hexyldecanoate) (Lipid 10a-130)
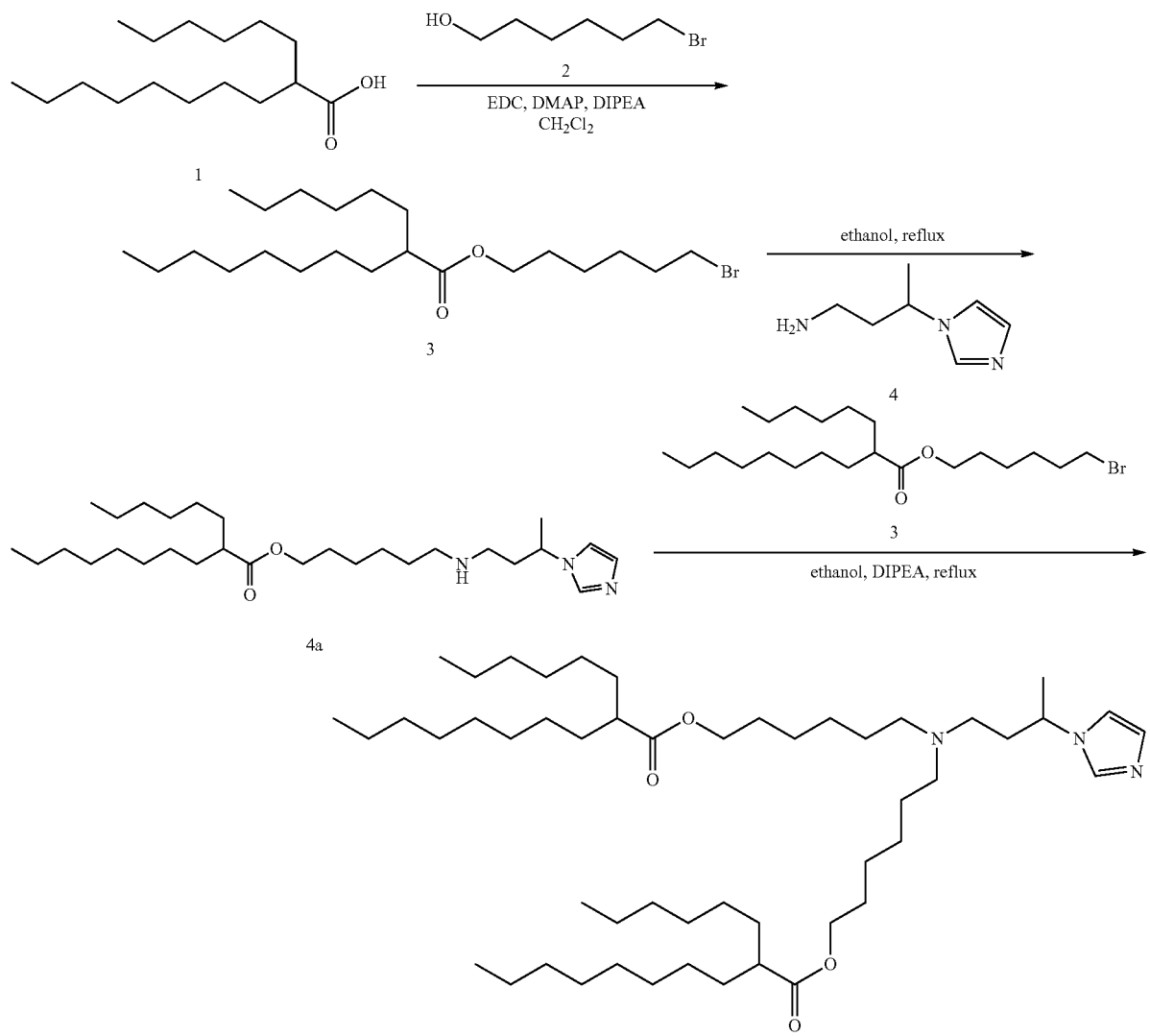
Lipid 10a-130 is synthesized according to the scheme above. Reaction conditions are identical to Lipid 10a-139 with the exception of 3-(1H-imidazol-1-yl)butyl amine as the imidazole amine.
40.12 Synthesis of (((1-Methyl-1H-imidazol-2-yl)methyl)azanediyl)bis(hexane-6,1-diyl) bis(2-hexyldecanoate) (Lipid 10a-128)
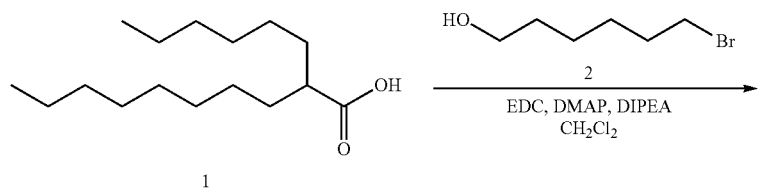

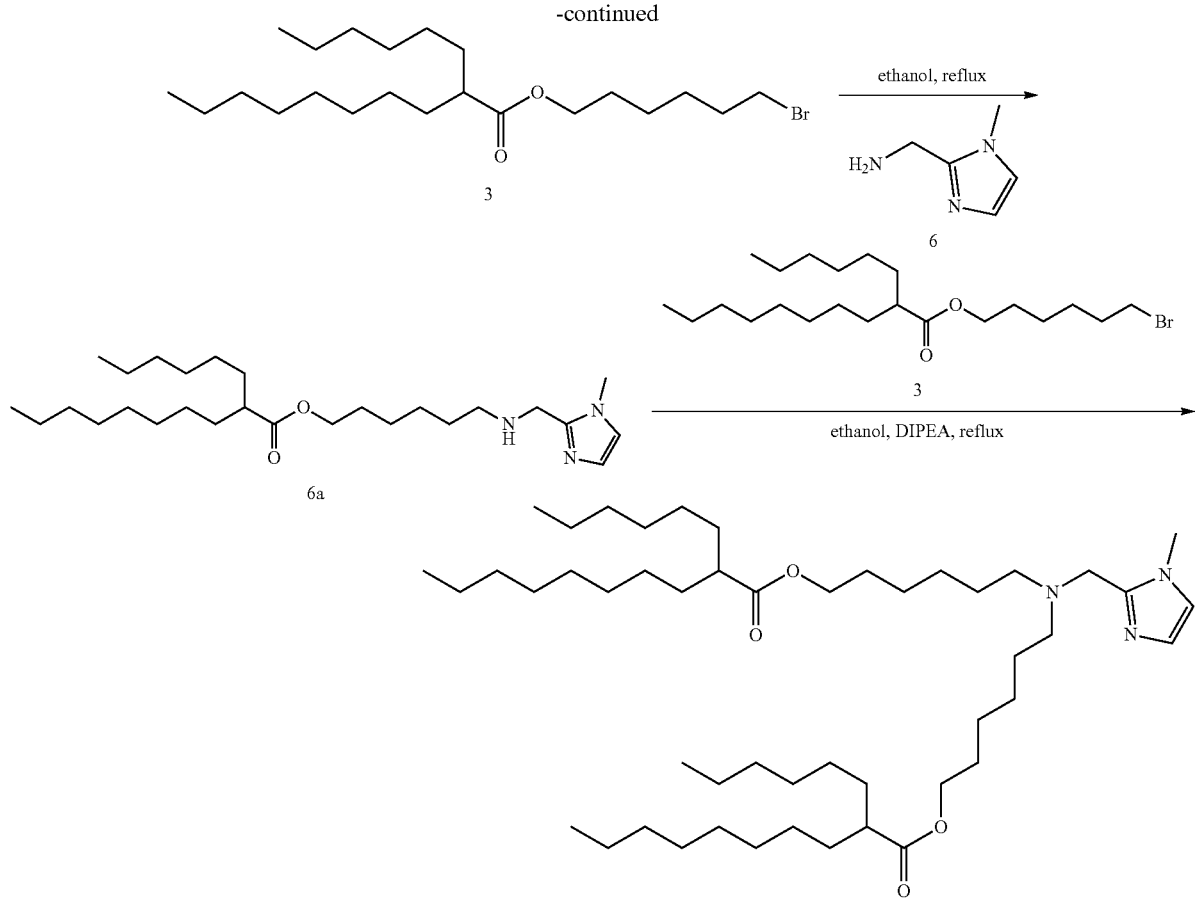

Lipid 10a-128 is synthesized according to the scheme above. Reaction conditions are identical to Lipid 10a-139 with the exception of 1-Methyl-1H-imidazol-2-yl)methyl amine as the imidazole amine.

$^1$H-NMR (300 MHz, CDCl$_3$): δ 6.89 (d, J=1.4 Hz, 1H), 6.81 (d, J=1.4 Hz, 1H), 4.03 (t, J=6.7 Hz, 4H), 3.68 (s, 3H), 3.62 (s, 2H), 2.45-2.20 (m, 6H), 1.65-1.50 (m, 8H), 1.5-1.35 (m, 8H), 1.35-1.10 (m, 48H), 0.86 (t, J=6.5 Hz, 12H). MS (APCI+): 787.6 (M+1).

Example 41

Lipid Nanoparticle Formulation with Circular RNA

Lipid Nanoparticles (LNPs) were formed using a Precision Nanosystems Ignite instrument with a 'NextGen' mixing chamber. Ethanol phase contained ionizable Lipid 10a-26, DSPC, Cholesterol, and DSPE-PEG 2000 (Avanti Polar Lipids Inc.) at a weight ratio of 16:1:4:1 or 62:4:33:1 molar ratio was combined with an aqueous phase containing circular RNA and 25 mM sodium acetate buffer at pH 5.2. A 3:1 aqueous to ethanol mixing ratio was used. The formulated LNP then were dialyzed in 1 L of water and exchanged 2 times over 18 hours. Dialyzed LNPs were filtered using 0.2 μm filter. Prior to in vivo dosing, LNPs were diluted in PBS. LNP sizes were determined by dynamic light scattering. A cuvette with 1 mL of 20 μg/mL LNPs in PBS (pH 7.4) was measured for Z-average using the Malvern Panalytical Zetasizer Pro. The Z-average and polydispersity index were recorded.

41.1 Formulation of Lipids 10a-26 and 10a-27

Lipid Nanoparticles (LNPs) were formed using a Precision Nanosystems Ignite instrument with a 'NextGen' mixing chamber. Ethanol phase contained ionizable Lipid 10a-26 or Lipid 10a-27, DOPE, Cholesterol, and DSPE-PEG 2000 (Avanti Polar Lipids Inc.) at a weight ratio of 16:1:4:1 or 62:4:33:1 molar ratio was combined with an aqueous phase containing circular RNA and 25 mM sodium acetate buffer at pH 5.2. A 3:1 aqueous to ethanol mixing ratio was used. The formulated LNPs were then dialyzed in 1 L of water and exchanged 2 times over 18 hours. Dialyzed LNPs were filtered using 0.2 μm filter. Prior to in vivo dosing, LNPs were diluted in PBS. LNP sizes were determined by dynamic light scattering. A cuvette with 1 mL of 20 μg/mL LNPs in PBS (pH 7.4) was measured for Z-average using the Malvern Panalytical Zetasizer Pro. The Z-average and polydispersity index were recorded.

41.2 Formulation of Lipids 10a-53 and 10a-54

Lipid Nanoparticles (LNPs) were formed using a Precision Nanosystems Ignite instrument with a 'NextGen' mixing chamber. Ethanol phase contained ionizable Lipid 10a-53 or 10a-54, DOPE, Cholesterol, and DSPE-PEG 2000 (Avanti Polar Lipids Inc.) at a molar ratio of 50:10:38.5:1.5 was combined with an aqueous phase containing circular RNA and 25 mM sodium acetate buffer at pH 5.2. A 3:1 aqueous to ethanol mixing ratio was used. The formulated LNPs were then dialyzed in IL of 1×PBS and exchanged 2 times over 18 hours. Dialyzed LNPs were filtered using 0.2 µm filter. Prior to in vivo dosing, LNPs were diluted in PBS. LNP sizes were determined by dynamic light scattering. A cuvette with 1 mL of 20 µg/mL LNPs in PBS (pH 7.4) was measured for Z-average using the Malvern Panalytical Zetasizer Pro. The Z-average and polydispersity index were recorded.

LNP zeta potential was measured using the Malvern Panalytical Zetasizer Pro. A mixture containing 200 µL of the particle solution in water and 800 µL of distilled RNAse-free water with a final particle concentration of 400 µg/mL was loaded into a zetasizer capillary cell for analysis.

RNA encapsulation was determined using a Ribogreen assay. Nanoparticle solutions were diluted in tris-ethylene-diaminetetraacetic acid (TE) buffer at a theoretical circRNA concentration of 2 µg/mL. Standard circRNA solutions diluted in TE buffer were made ranging from 2 µg/mL to 0.125 µg/mL. The particles and standards were added to all wells and a second incubation was performed (37° C. at 350 rpm for 3 minutes). Fluorescence was measured using a SPECTRAmax® GEMINI XS microplate spectrofluorometer. The concentration of circular RNA in each particle solution was calculated using the standard curve. The encapsulation efficiency was calculated from the ratio of circRNA detected between lysed and unlysed particles.

TABLE 22a

Characterization of LNPs

| Ionizable Lipid | Size (nm) | PDI | Encapsulation Efficiency (%) | Zeta Data Potential (mV) |
|---|---|---|---|---|
| 22-S14 | 88 | 0.09 | 96 | 3.968 |
| 93-S14 | 119 | 0.02 | 96 | −6.071 |
| Lipid 10a-26 | 86 | 0.08 | 92 | −15.24 |

TABLE 22b

Characterization of LNPs

| Ionizable Lipid | Z-Average (nm) | PDI | RNA Entrapment (%) |
|---|---|---|---|
| 22-S14 | 64 | 0.05 | 97 |
| 93-S14 | 74 | 0.04 | 95 |
| Lipid 10a-26 | 84 | 0.04 | 96 |

Example 42

In Vivo Analysis

Female CD-1 or female c57BL/6J mice ranging from 22-25 g were dosed at 0.5 mg/kg RNA intravenously. Six hours after injection, mice were injected intraperitoneally with 200 µL of D-luciferin at 15 mg/mL concentration. 5 minutes after injection, mice were anesthetized using isoflurane, and placed inside the IVIS Spectrum In Vivo Imaging System (Perkin Elmer) with dorsal side up. Whole body total IVIS flux of Lipids 22-514, 93-514, Lipid 10a-26 is presented in FIG. 32A. Post 10 minutes injection, mice were scanned for luminescence. Mice were euthanized and organs were extracted within 25 minutes of luciferin injection to scan for luminescence in liver, spleen, kidneys, lungs, and heart. Images (FIGS. 33A-B, 34A-B, 35A-B) were analyzed using Living Images (Perkin Elmer) software. Regions of interest were drawn to obtain flux and average radiance and analyzed for biodistribution of protein expression (FIG. 32A-B).

Figure 32A:
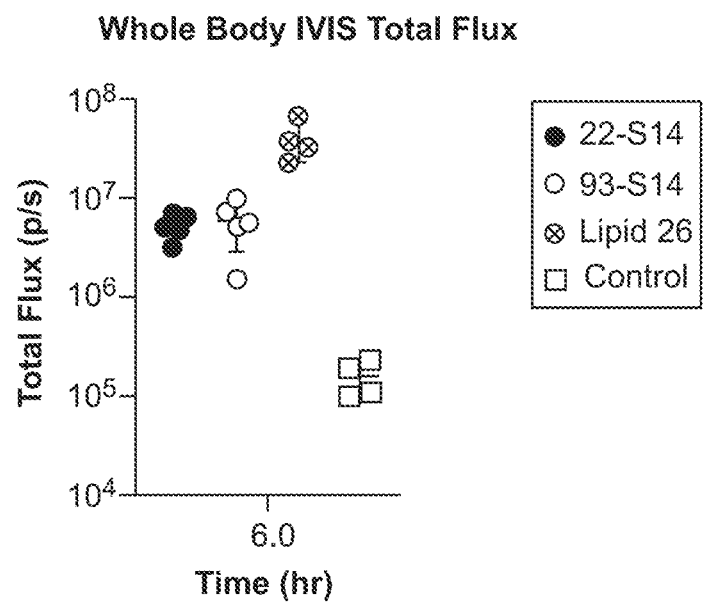
FIG. 32A depicts total flux of spleen and liver harvested from CD-1 mice dosed with circular RNA encoding firefly luciferase (FLuc) and formulated with ionizable lipid of interest, DSPC, cholesterol, and DSPE-PEG 2000 (Avanti Polar Lipids Inc.) at a weight ratio of 16:1:4:1 or 62:4:33:1 molar ratio.
Figure 32B:
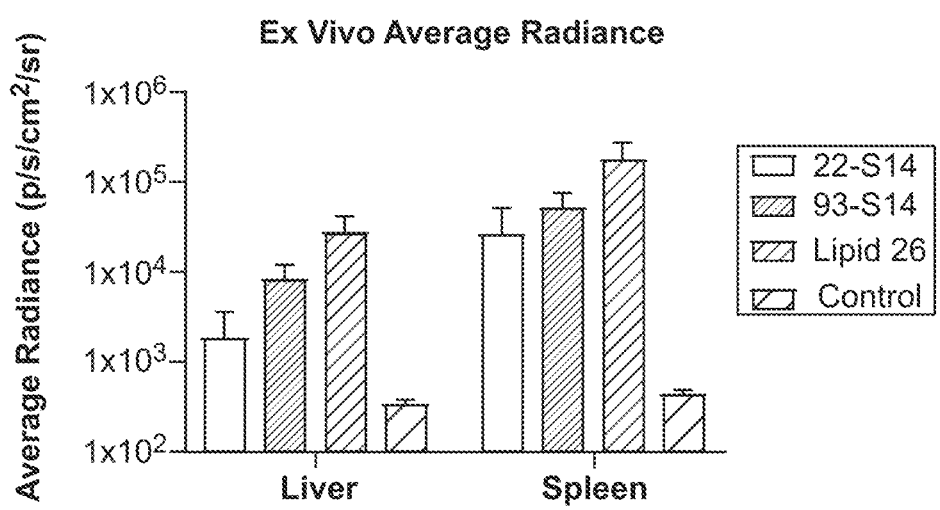
FIG. 32B depicts average radiance for biodistribution of protein expression.
Figure 33A:
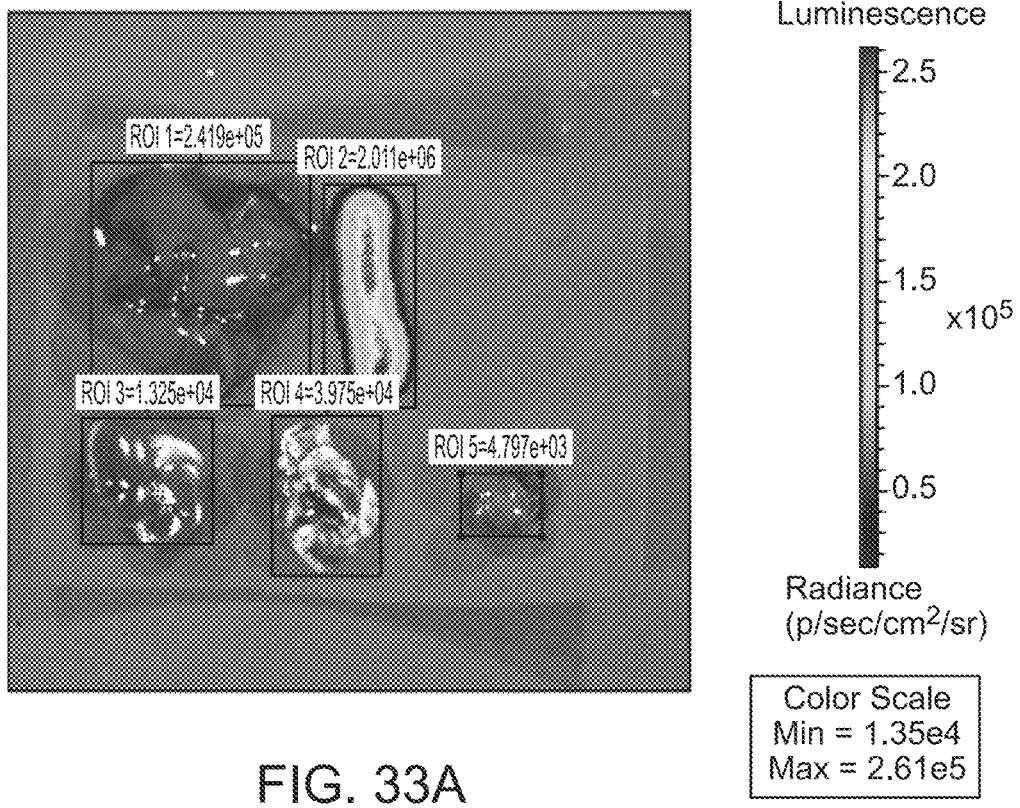
FIG. 33A depicts images highlighting the luminescence of organs harvested from CD-1 mice dosed with circular RNA encoding FLuc and formulated with ionizable Lipid 22-S14, DSPC, cholesterol, and DSPE-PEG 2000 (Avanti Polar Lipids Inc.) at a weight ratio of 16:1:4:1 or 62:4:33:1 molar ratio.
Figure 33B:
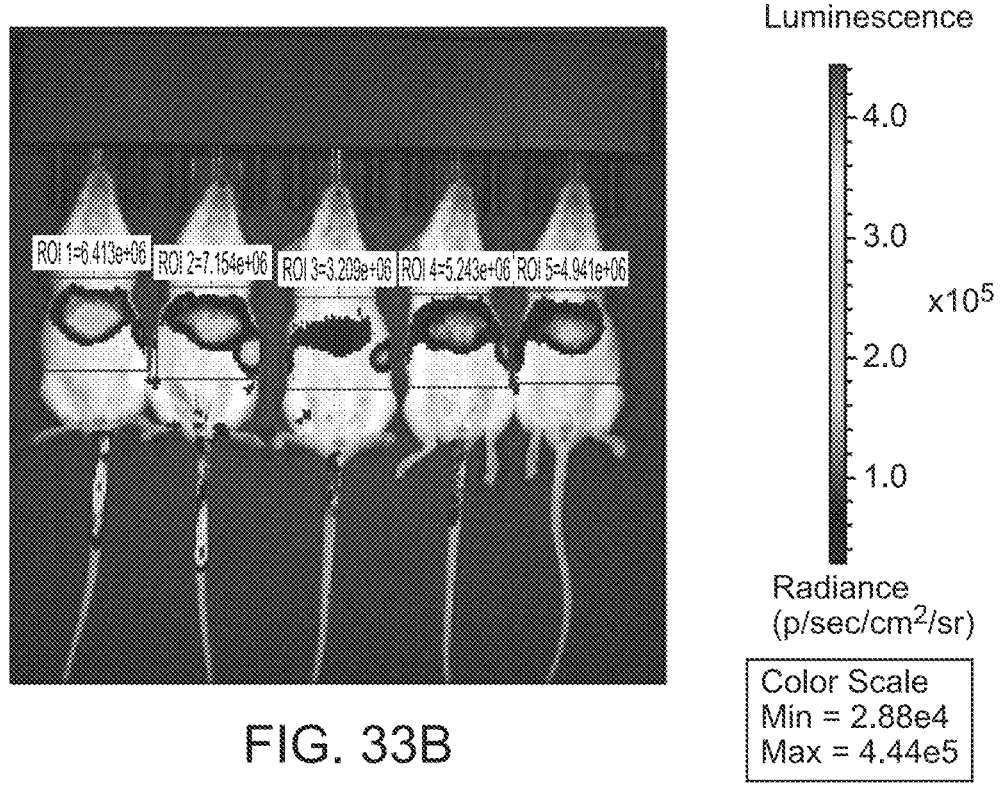
FIG. 33B depicts whole body IVIS images of CD-1 mice dosed with circular RNA encoding FLuc and formulated with ionizable Lipid 22-S14, DSPC, cholesterol, and DSPE-PEG 2000 (Avanti Polar Lipids Inc.) at a weight ratio of 16:1:4:1 or 62:4:33:1 molar ratio.
Figure 34A:
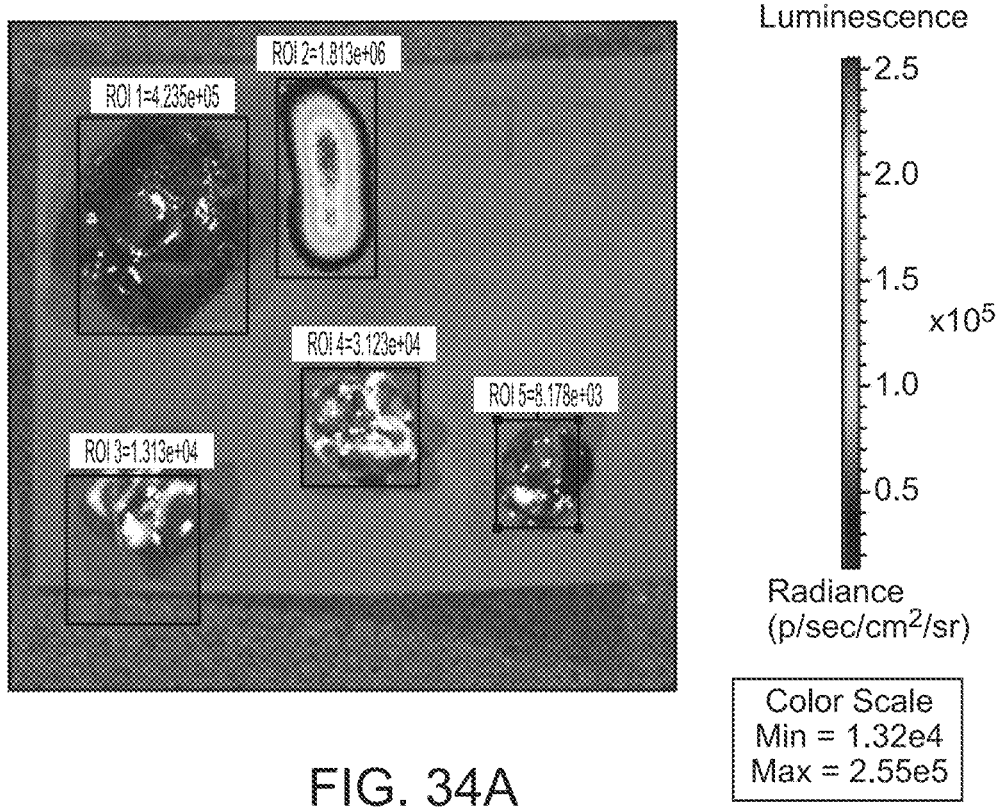
FIG. 34A depicts images highlighting the luminescence of organs harvested from CD-1 mice dosed with circular RNA encoding FLuc and formulated with ionizable Lipid 93-S14, DSPC, cholesterol, and DSPE-PEG 2000 (Avanti Polar Lipids Inc.) at a weight ratio of 16:1:4:1 or 62:4:33:1 molar ratio.
Figure 34B:
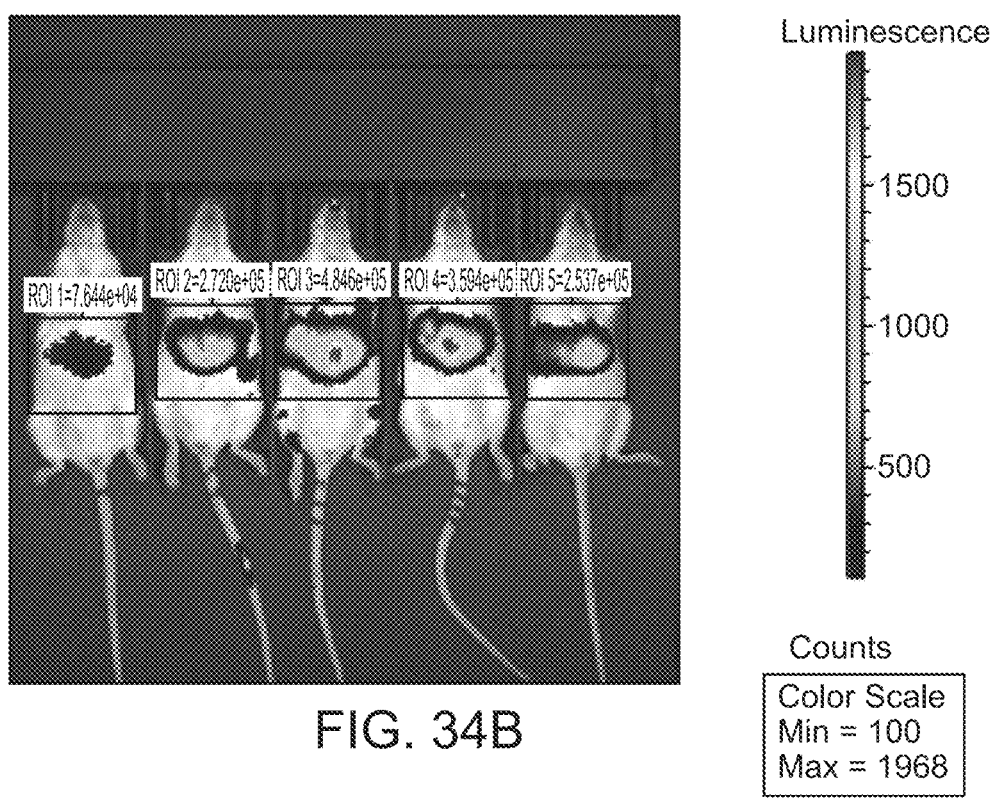
FIG. 34B depicts whole body IVIS images of CD-1 mice dosed with circular RNA encoding FLuc and formulated with ionizable Lipid 93-S14, DSPC, cholesterol, and DSPE-PEG 2000 (Avanti Polar Lipids Inc.) at a weight ratio of 16:1:4:1 or 62:4:33:1 molar ratio.
Figure 35A:
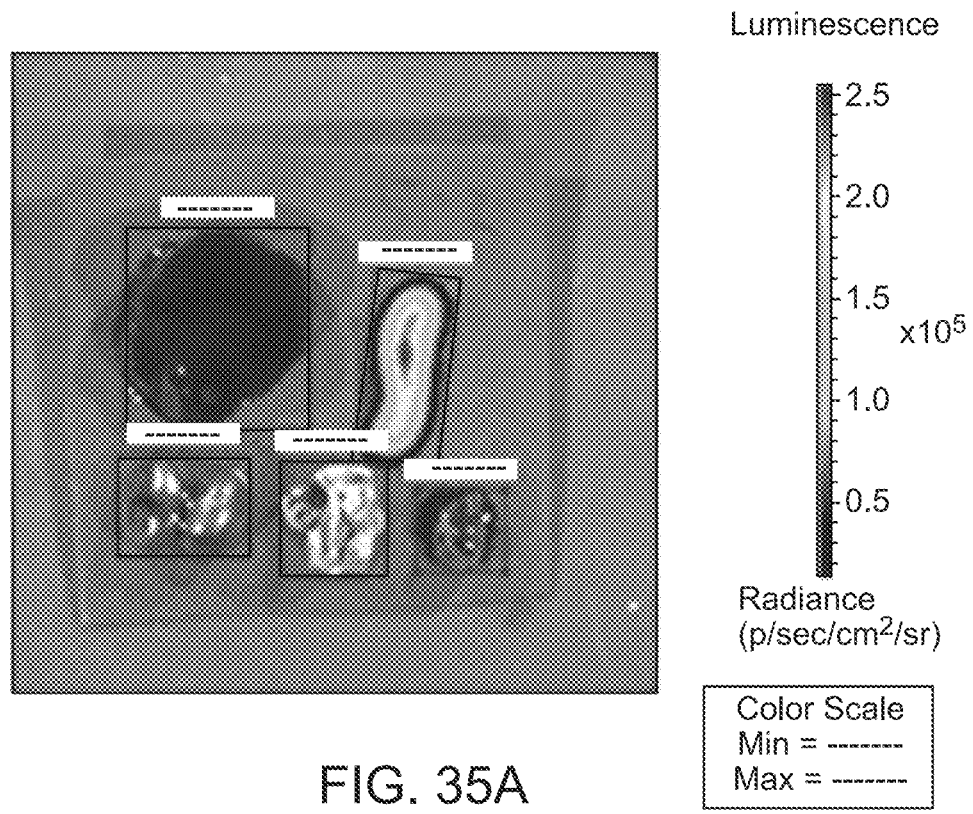
FIG. 35A depicts images highlighting the luminescence of organs harvested from CD-1 mice dosed with circular RNA encoding FLuc and formulated with ionizable Lipid 10a-26, DSPC, cholesterol, and DSPE-PEG 2000 (Avanti Polar Lipids Inc.) at a weight ratio of 16:1:4:1 or 62:4:33:1 molar ratio.
Figure 35B:
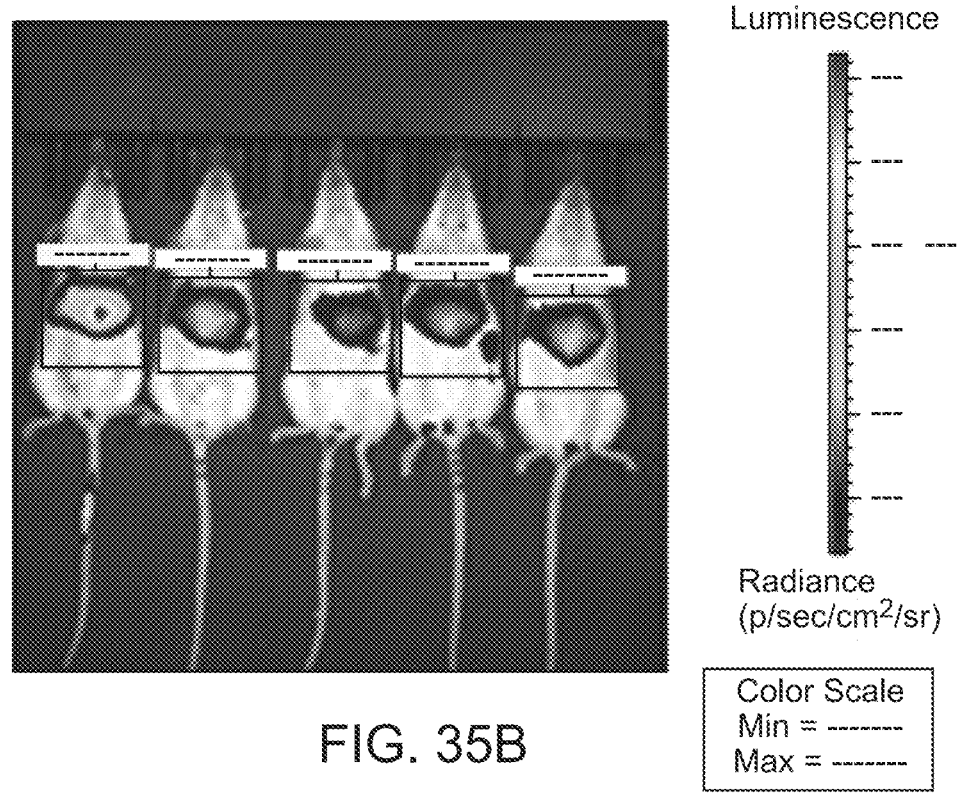
FIG. 35B depicts whole body IVIS images of CD-1 mice dosed with circular RNA encoding FLuc and formulated with ionizable Lipid 10a-26, DSPC, cholesterol, and DSPE-PEG 2000 (Avanti Polar Lipids Inc.) at a weight ratio of 16:1:4:1 or 62:4:33:1 molar ratio.

FIG. 32A illustrates the increased whole-body total flux observed from luciferase circRNA with Lipid 10a-26 LNPs compared to LNPs made with lipids 22-S14 and 93-S14. FIG. 32B shows the ex vivo IVIS analysis of tissues further highlighting the increased overall expression with Lipid 10a-26 while maintaining the desired spleen to liver ratios observed with lipids 22-S14 and 93-S14 despite the significant structural changes designed to improve expression. These data highlight the improvements afforded by Lipid 10a-26 compared to previously reported lipids.

Figure 36C:
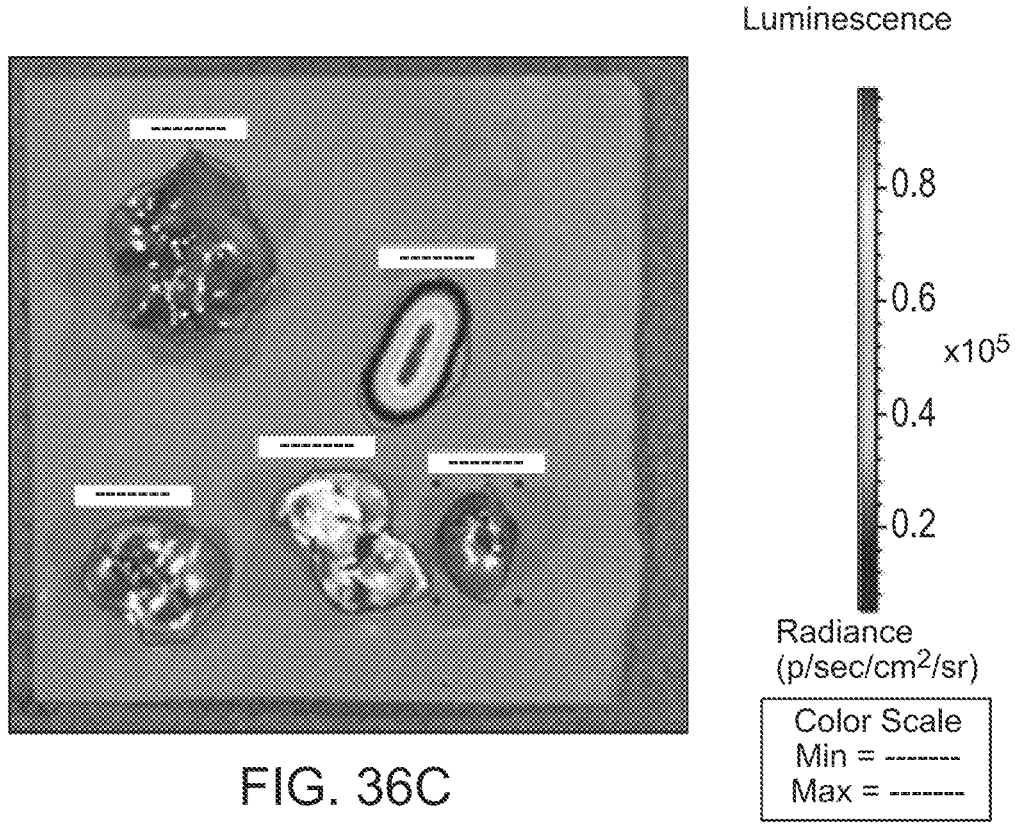
Figure 36D:
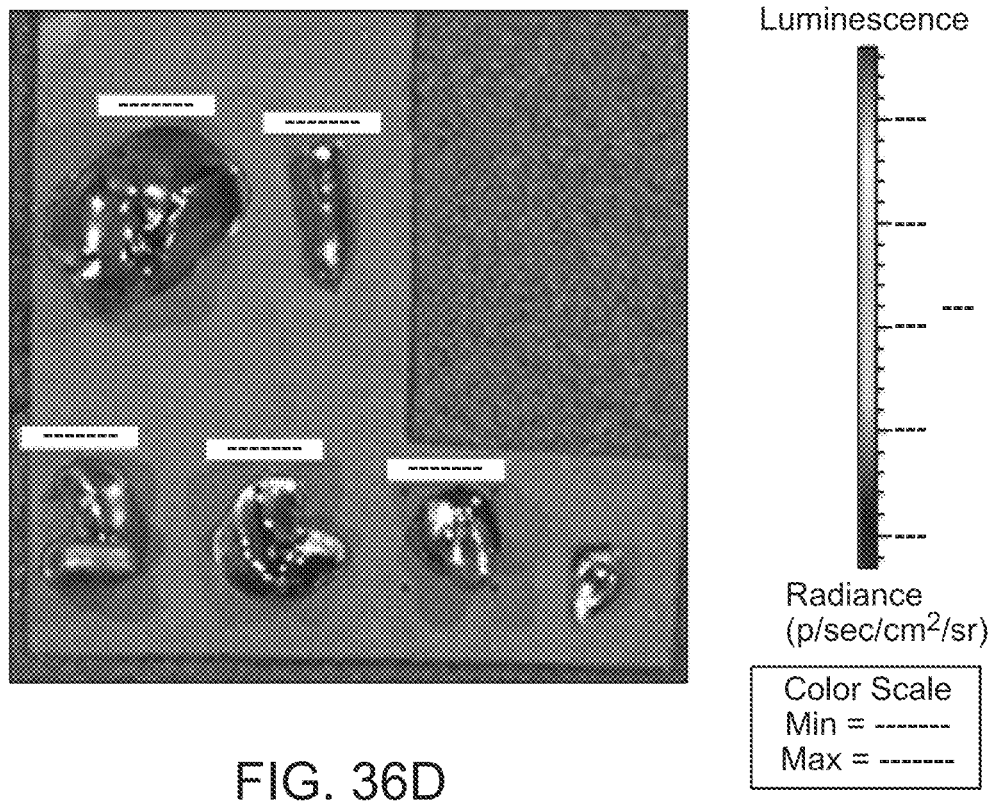

Similar analysis as described above was also performed with circRNA encapsulated in LNPs formed with Lipid 10b-15 or Lipid 10a-53 or 10a-54. FIGS. 36A-C show the ex vivo IVIS analysis of tissues, respectively highlighting the overall expression with Lipid 10b-15, 10a-53, and 10a-54 while maintaining the desired spleen to liver ratios despite the significant structural changes designed to improve expression. FIG. 36D shows the results for PBS control. These data demonstrates the improvements afforded by Lipids 10b-15, 10a-53, and 10a-54 compared to previously reported lipids such as 93-S14 and 22-514.

Example 43

Delivery of Luciferase

Human peripheral blood mononuclear cells (PBMCs) (Stemcell Technologies) were transfected with lipid nanoparticles (LNP) encapsulating firefly luciferase (f.luc) circular RNA and examined for luciferase expression. PBMCs from two different donors were incubated in vitro with five different LNP compositions, containing circular RNA encoding for firefly luciferase (200 ng), at 37° C. in RPMI, 2% human serum, IL-2 (10 ng/mL), and 50 uM BME. PBMCs incubated without LNP were used as a negative control. After 24 hours, the cells were lysed and analyzed for firefly luciferase expression based on bioluminescence (Promega BrightGlo).

Figure 37A:
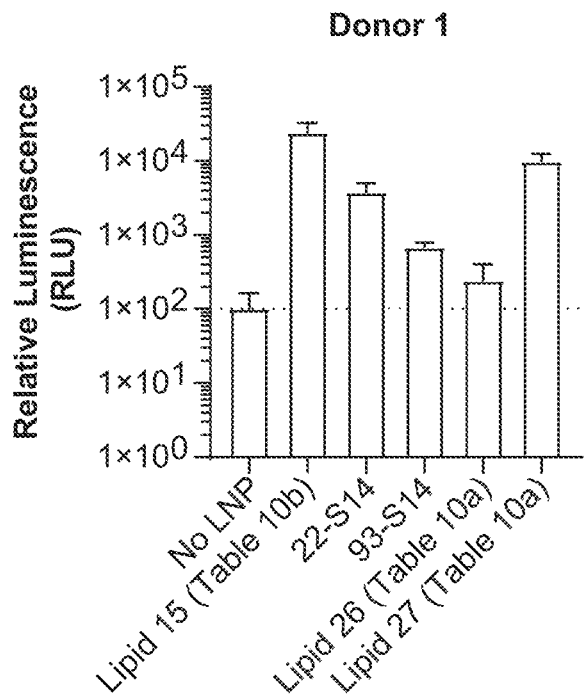
FIGS. 37A and 37B depict relative luminescence in the lysates of human PBMCs after 24-hour incubation with testing lipid nanoparticles containing circular RNA encoding firefly luciferase.
Figure 37B:
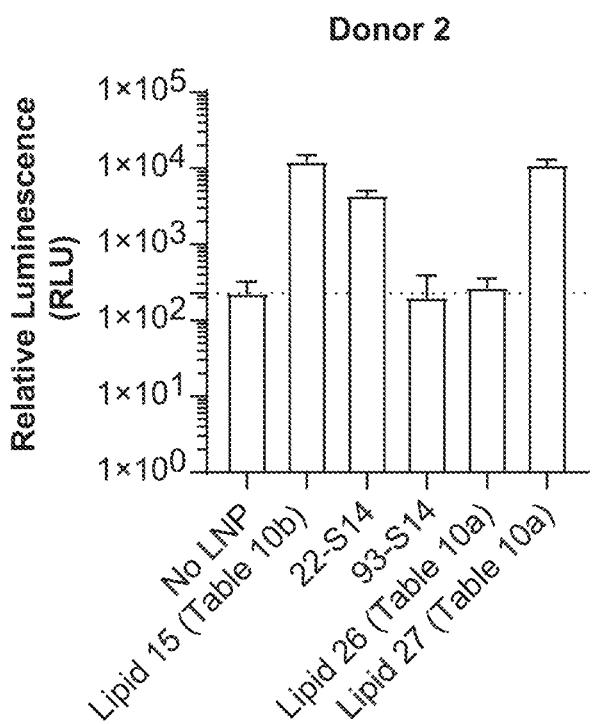

Representative data are presented in FIGS. 37A and 37B, showing that that the tested LNPs are capable of delivering circular RNA into primary human immune cells resulting in protein expression.

Example 44

In Vitro Delivery of Green Fluorescent Protein (GFP) or Chimeric Antigen Receptor (CAR)

Human PBMCs (Stemcell Technologies) were transfected with LNP encapsulating GFP and examined by flow cytometry. PBMCs from five different donors (PBMC A-E) were incubated in vitro with one LNP composition, containing circular RNA encoding either GFP or CD19-CAR (200 ng), at 37° C. in RPMI, 2% human serum, IL-2 (10 ng/mL), and 50 uM BME. PBMCs incubated without LNP were used as a negative control. After 24, 48, or 72 hours post-LNP incubation, cells were analyzed for CD3, CD19, CD56, CD14, CD11b, CD45, fixable live dead, and payload (GFP or CD19-CAR).

Figure 38A:
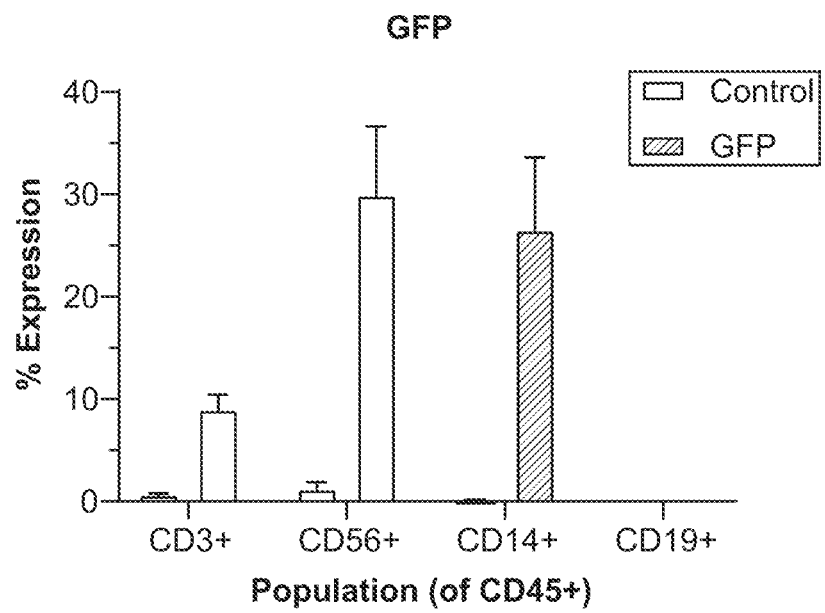
FIGS. 38A and 38B show the expression of GFP (FIG. 38A) and CD19 CAR (FIG. 38B) in human PBMCs after incubating with testing lipid nanoparticle containing circular RNA encoding either GFP or CD19 CAR.
Figure 38B:
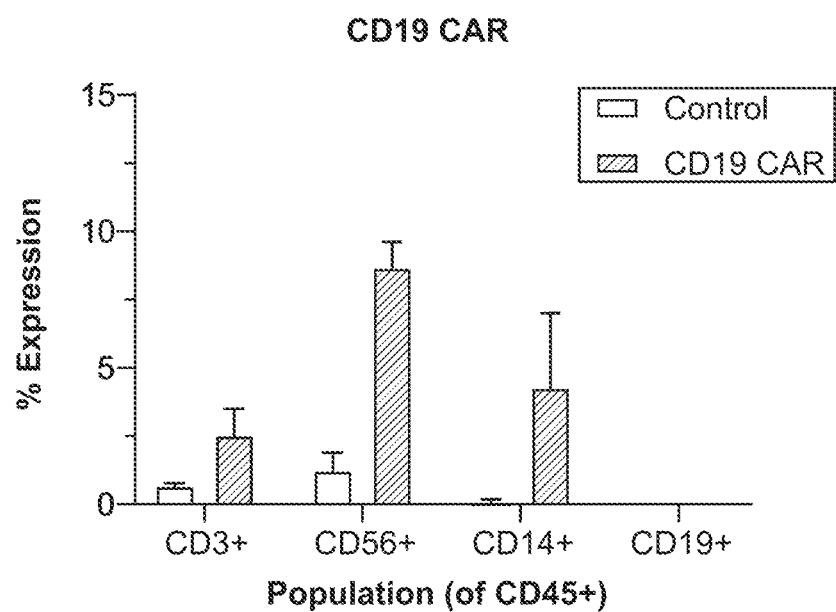

Representative data are presented in FIGS. 38A and 38B, showing that the tested LNP is capable of delivering circular RNA into primary human immune cells resulting in protein expression.

Example 45

Multiple IRES Variants can Mediate Expression of Murine CD19 CAR In Vitro

Multiple circular RNA constructs, encoding anti-murine CD19 CAR, contains unique IRES sequences and were lipotransfected into 1C1C7 cell lines. Prior to lipotransfection, 1C1C7 cells are expanded for several days in complete RPMI Once the cells expanded to appropriate numbers, 1C1C7 cells were lipotransfected (Invitrogen RNAiMAX) with four different circular RNA constructs. After 24 hours, 1C1C7 cells were incubated with His-tagged recombinant murine CD19 (Sino Biological) protein, then stained with a secondary anti-His antibody. Afterwards, the cells were analyzed via flow cytometry.

Figure 39:
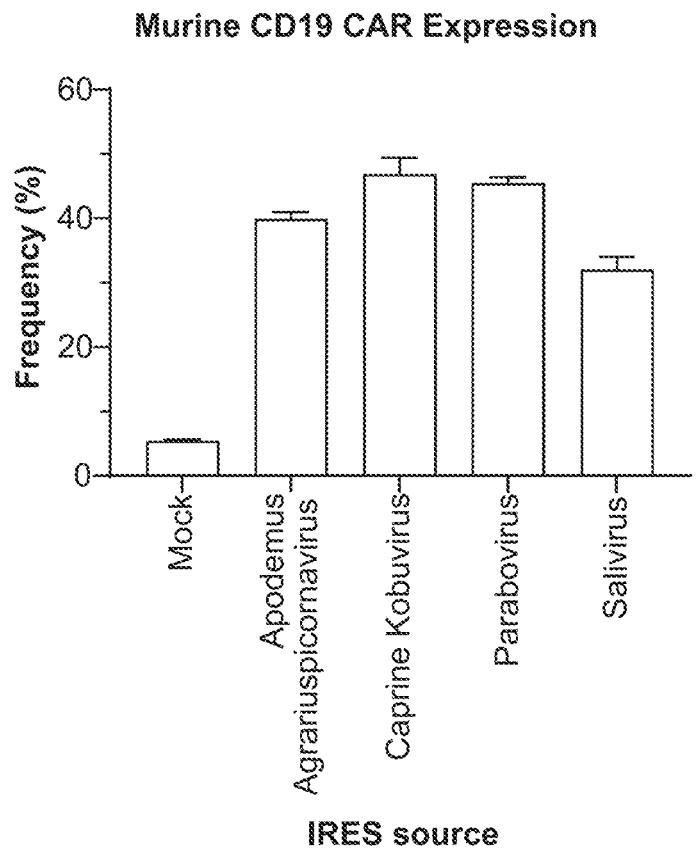
FIG. 39 depicts the expression of an anti-murine CD19 CAR in 1C1C7 cells lipotransfected with circular RNA comprising an anti-murine CD19 CAR expression sequence and varying IRES sequences.

Representative data are presented in FIGS. 39, showing that IRES sourced from the indicated virus (*Apodemus agrarius* picornavirus, caprine kobuvirus, parabovirus, and salivirus) are capable of driving expression of an anti-mouse CD19 CAR in murine T cells.

Example 46

Murine CD19 CAR Mediates Tumor Cell Killing In Vitro

Circular RNA encoding anti-mouse CD19 CAR were electroporated into murine T cells to evaluate CAR-mediated cytotoxicity. For electroporation, T cells were electroporated with circular RNA encoding anti-mouse CD19 CAR using ThermoFisher's Neon Transfection System then rested overnight. For the cytotoxicity assay, electroporated T cells were co-cultured with Fluc+ target and non-target cells at 1:1 ratio in complete RPMI containing 10% FBS, IL-2 (10 ng/mL), and 50 uM BME and incubated overnight at 37° C. Cytotoxicity was measured using a luciferase assay system 24 hours post-co-culture (Promega Brightglo Luciferase System) to detect lysis of Fluc+ target and non-target cells. Values shown are calculated relative to the untransfected mock signal.

Figure 40:
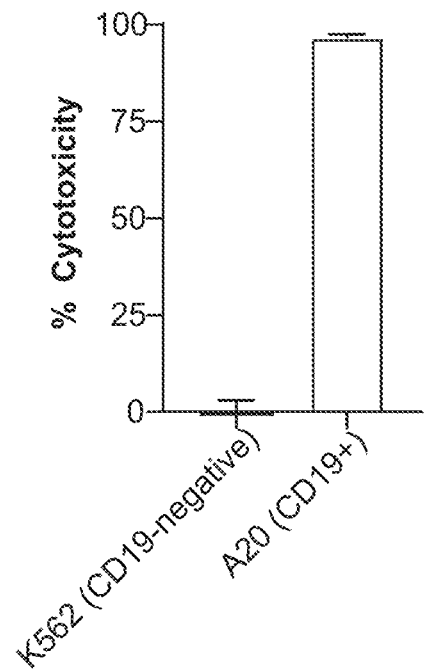
FIG. 40 shows the cytotoxicity of an anti-murine CD19 CAR to murine T cells. The CD19 CAR is encoded by and expressed from a circular RNA, which is electroporated into the murine T cells.

Representative data are presented in FIG. 40, showing that an anti-mouse CD19 CAR expressed from circular RNA is functional in murine T cells in vitro.

Example 47

Functional Depletion of B Cells with a Lipid Encapsulated Circular RNA Encoding Murine CD19 CAR C57BL/6J mice were injected with LNP formed with Lipid 10b-15, encapsulating circular RNA encoding anti-murine CD19 CAR. As a control, Lipid 10b-15 encapsulating circular RNA encoding firefly luciferase (f.Luc) were injected in different group of mice. Female C57BL.6J, ranging from 20-25 g, were injected intravenously with 5 doses of 0.5 mg/kg of LNP, every other day. Between injections, blood draws were analyzed via flow cytometry for fixable live/dead, CD45, TCRvb, B220, CD11b, and anti-murine CAR. Two days after the last injection, spleens were harvested and processed for flow cytometry analysis. Splenocytes were stained with fixable live/dead, CD45, TCRvb, B220, CD11b, NK1.1, F4/80, CD11c, and anti-murine CAR. Data from mice injected with anti-murine CD19 CAR LNP were normalized to mice that received f.Luc LNP.

Figure 41A:
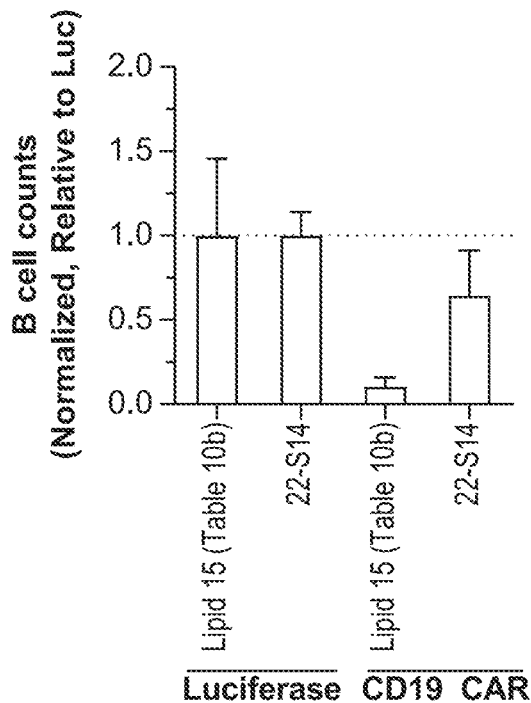
FIGS. 41A-41C depict the B cell counts in peripheral blood (FIGS. 40A and 40B) or spleen (FIG. 40C) in C57BL/6J mice injected every other day with testing lipid nanoparticles encapsulating a circular RNA encoding an anti-murine CD19 CAR.
Figure 41B:
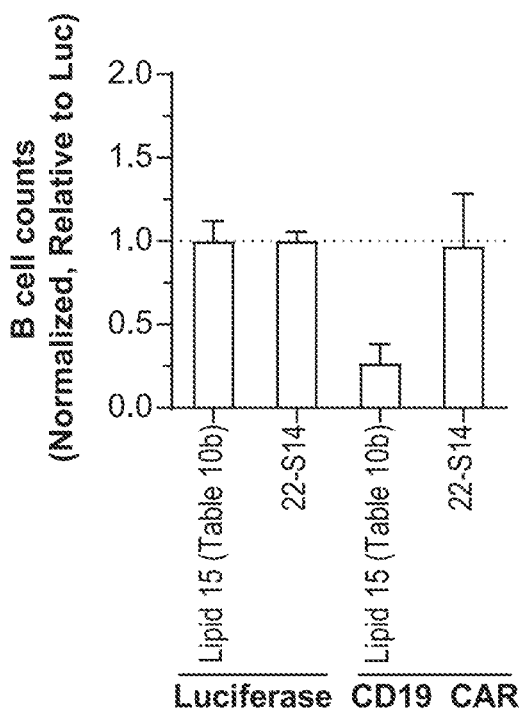
Figure 41C:
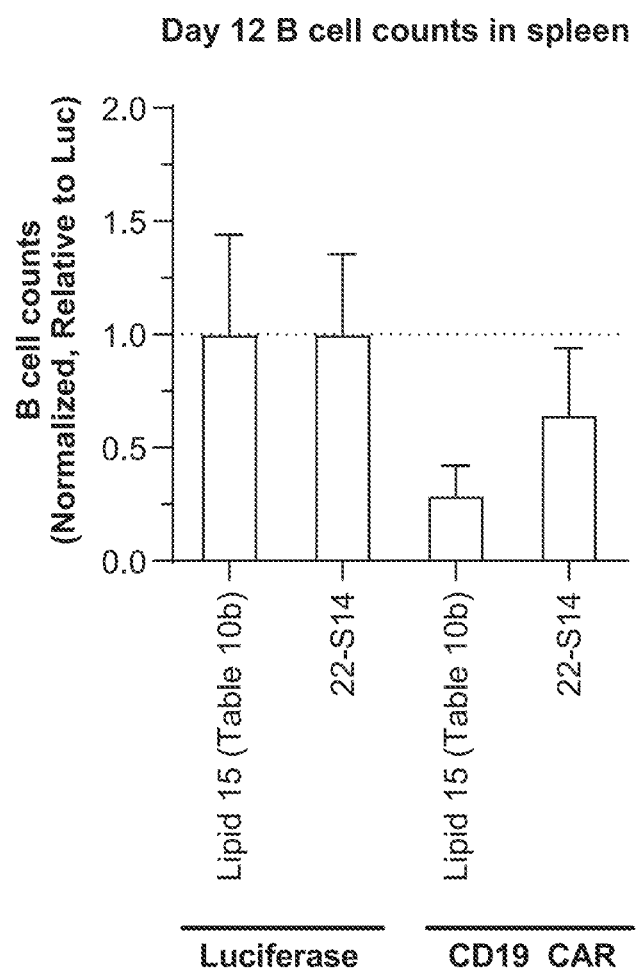

Representative data are presented in FIGS. 41A, 41B, and 41C, showing that an anti-mouse CD19 CAR expressed from circular circRNA delivered in vivo with LNPs is functional in murine T cells in vivo.

Example 48

CD19 CAR Expressed from Circular RNA has Higher Yield and Greater Cytotoxic Effect Compared to that Expressed from mRNA Circular RNA encoding encoding anti-CD19 chimeric antigen antigen receptor, which includes, from N-terminus to C-terminus, a FMC63-derived scFv, a CD8 transmembrane domain, a 4-1BB costimulatory domain, and a CD3 (intracellular domain, were electroporated into human peripheral T cells to evaluate surface expression and CAR-mediated cytotoxicity. For comparison, circular RNA-electroporated T cells were compared to mRNA-electroporated T cells in this experiment. For electroporation, CD3+ T cells were isolated from human PBMCs using commercially available T cell isolation kits (Miltenyi Biotec) from donor human PBMCs. After isolation, T cells were stimulated with anti-CD3/anti-CD28 (Stemcell Technologies) and expanded over 5 days at 37° C. in complete RPMI containing 10% FBS, IL-2 (10 ng/mL), and 50 uM BME. Five days post stimulation, T cells were electroporated with circular RNA encoding anti-human CD19 CAR using ThermoFisher's Neon Transfection System and then rested overnight. For the cytotoxicity assay, electroporated T cells were co-cultured with Fluc+ target and non-target cells at 1:1 ratio in complete RPMI containing 10% FBS, IL-2 (10 ng/mL), and 50 uM BME and incubated overnight at 37° C. Cytotoxicity was measured using a luciferase assay system 24 hours post-co-culture (Promega Brightglo Luciferase System) to detect lysis of Fluc+ target and non-target cells. Furthermore, an aliquot of electroporated T cells were taken and stained for live dead fixable staining, CD3, CD45, and chimeric antigen receptors (FMC63) at the day of analysis.

Figure 42A:
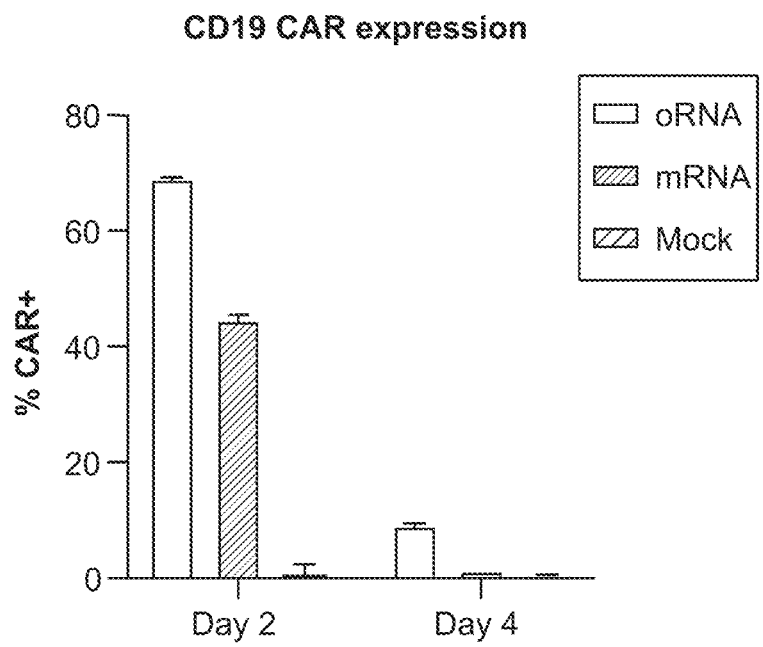
FIGS. 42A and 42B compare the expression level of an anti-human CD19 CAR expressed from a circular RNA with that expressed from a linear mRNA.
Figure 42B:
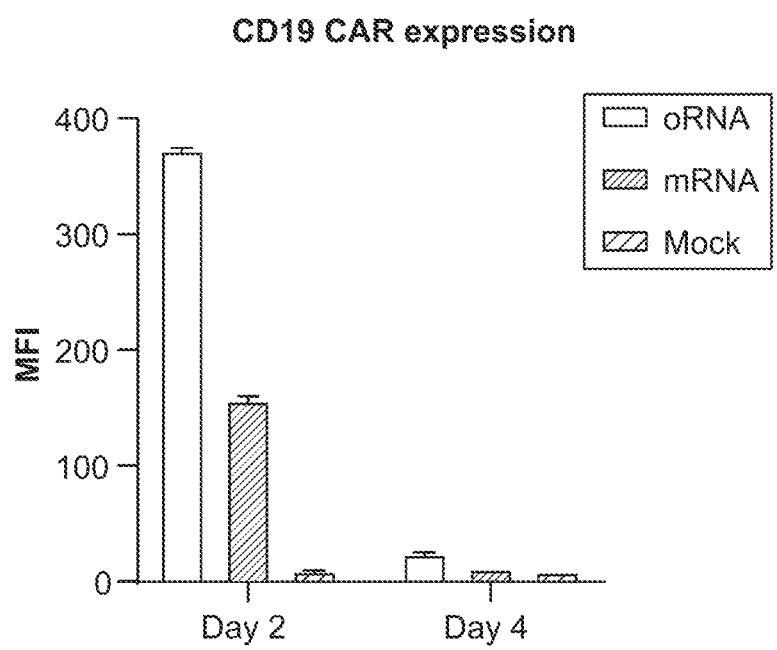
Figure 43A:
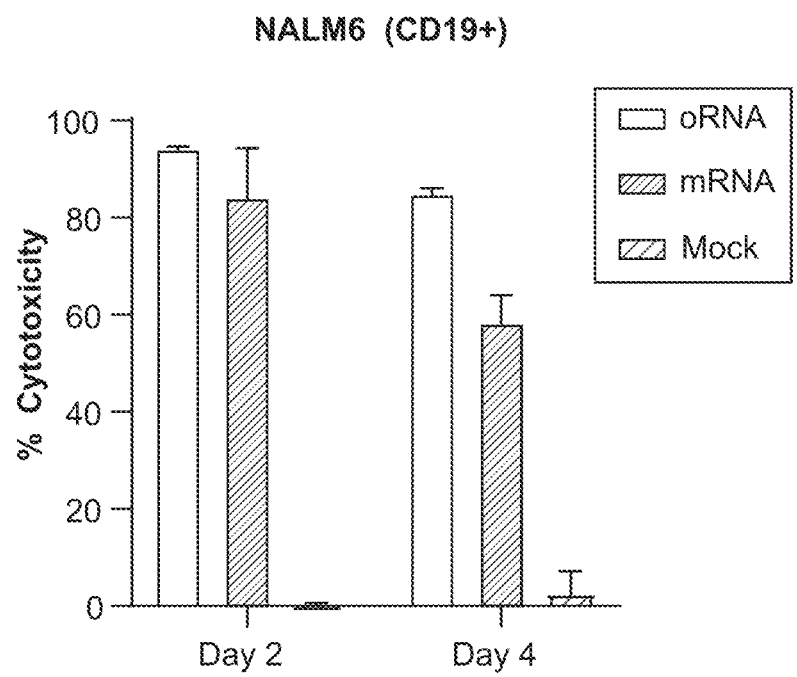
FIGS. 43A and 43B compare the cytotoxic effect of an anti-human CD19 CAR expressed from a circular RNA with that expressed from a linear mRNA
Figure 43B:
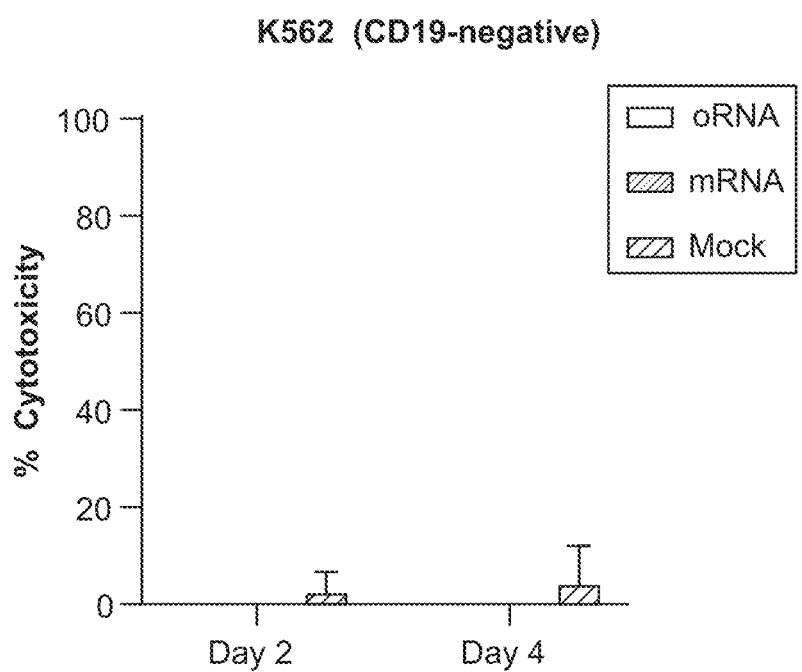

Representative data are presented in FIGS. 42 and 43. FIGS. 42A and 42B show that an anti-human CD19 CAR expressed from circular RNA is expressed at higher levels and longer than an anti-human CD19 CAR expressed from linear mRNA. FIGS. 43A and 43B show that an anti-human CD19 CAR expressed from circular RNA is exerts a greater cytotoxic effect relative a to anti-human CD19 CAR expressed from linear mRNA.

Example 49

Functional Expression of Two CARs from a Single Circular RNA

Circular RNA encoding chimeric antigen receptors were electroporated into human peripheral T cells to evaluate surface expression and CAR-mediated cytotoxicity. The purpose of this study is to evaluate if circular RNA encoding for two CARs can be stochastically expressed with a 2A (P2A) or an IRES sequence. For electroporation, CD3+ T cells were commercially purchased (Cellero) and stimulated with anti-CD3/anti-CD28 (Stemcell Technologies) and expanded over 5 days at 37° C. in complete RPMI containing 10% FBS, IL-2 (10 ng/mL), and 50 uM BME. Four days post stimulation, T cells were electroporated with circular RNA encoding anti-human CD19 CAR, anti-human CD19 CAR-2A-anti-human BCMA CAR, and anti-human CD19 CAR-IRES-anti-human BCMA CAR using ThermoFisher's Neon Transfection System then rested overnight. For the cytotoxicity assay, electroporated T cells were co-cultured with Fluc+K562 cells expressing human CD19 or BCMA antigens at 1:1 ratio in complete RPMI containing 10% FBS, IL-2 (10 ng/mL), and 50 uM BME and incubated overnight at 37° C. Cytotoxicity was measured using a luciferase assay system 24 hours post-co-culture (Promega BrightGlo Luciferase System) to detect lysis of Fluc+ target cells.

Figure 44:
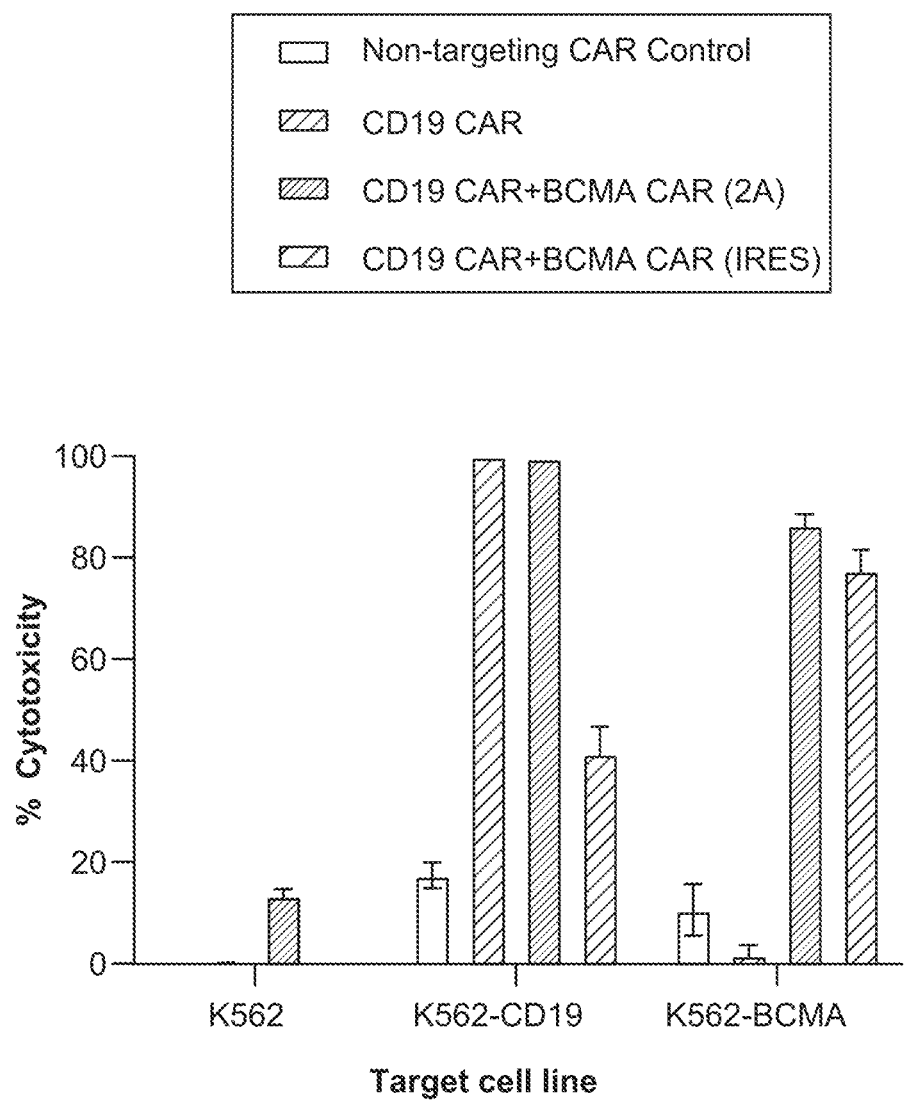
FIG. 44 depicts the cytotoxicity of two CARs (anti-human CD19 CAR and anti-human BCMA CAR) expressed from a single circular RNA in T cells.

Representative data are presented in FIG. 44, showing that two CARs can be functionally expressed from the same circular RNA construct and exert cytotoxic effector function.

Example 50

In Vivo Circular RNA Transfection Using Cre Reporter Mice

Circular RNAs encoding Cre recombinase (Cre) are encapsulated into lipid nanoparticles as previously described. Female, 6-8 week old B6.Cg-Gt(ROSA) 26Sortm9(CAG-tdTomato)Hze/J (Ai9) mice were dosed with lipid nanoparticles at 0.5 mg/kg RNA intravenously. Fluorescent tdTomato protein was transcribed and translated in Ai9 mice upon Cre recombination, meaning circular RNAs have been delivered to and translated in tdTomato+ cells. After 48 hr, mice were euthanized and the spleens were harvested, processed into a single cell suspension, and stained with various fluorophore-conjugated antibodies for immunophenotyping via flow cytometry.

Figure 45A:
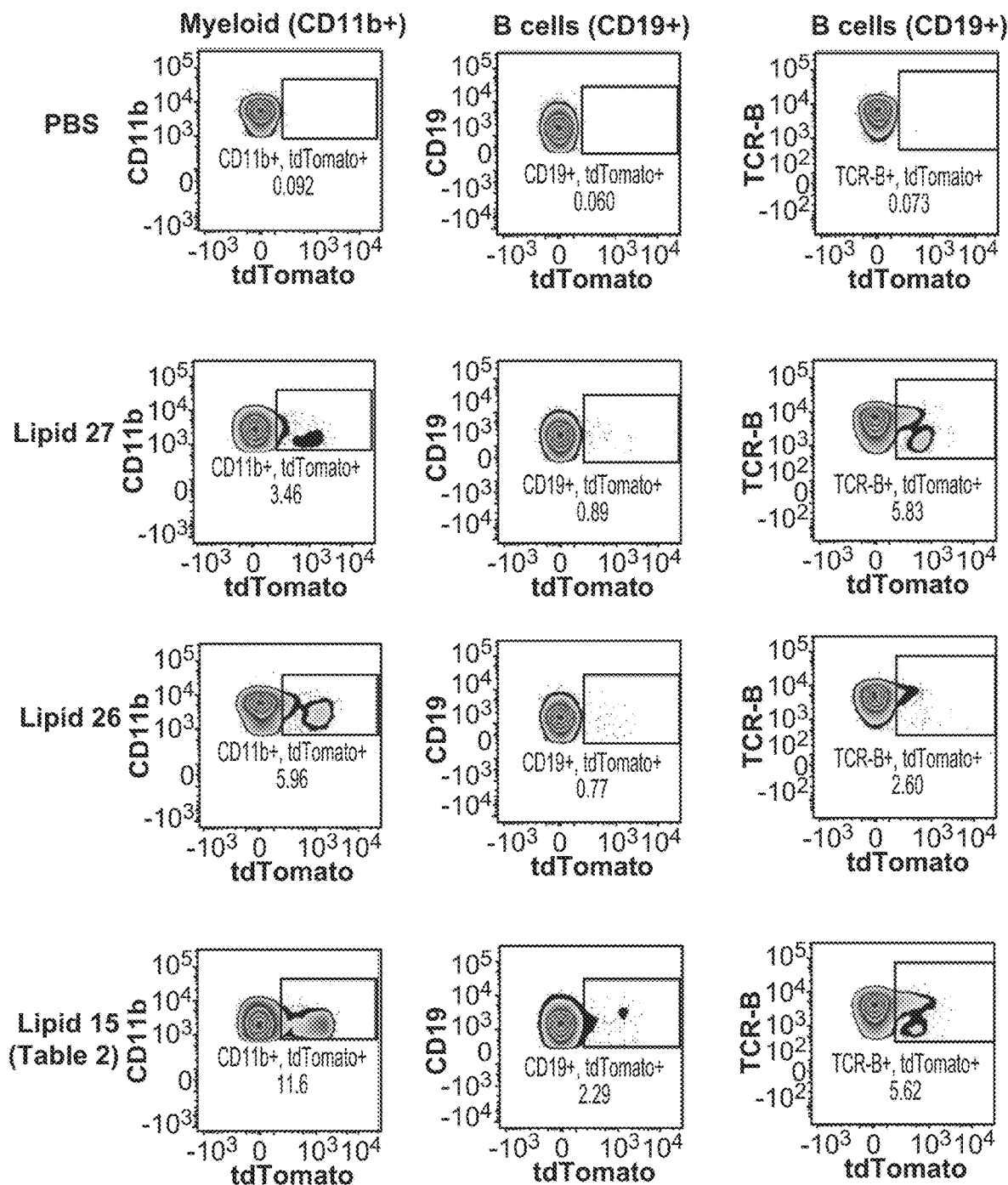
FIG. 45A shows representative FACS plots with frequencies of tdTomato expression in various spleen immune cell subsets following treatment with LNPs formed with Lipid 10a-27 or 10a-26 or Lipid 10b-15.
Figure 45B:
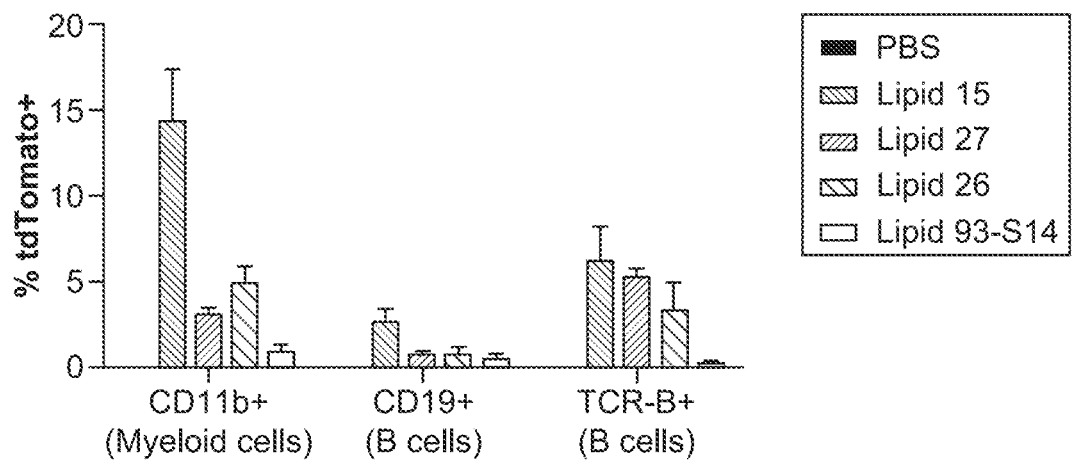
FIG. 45B shows the quantification of the proportion of myeloid cells, B cells, and T cells expressing tdTomato (mean+std. dev., n=3), equivalent to the proportion of each cell population successfully transfected with Cre circular RNA.

FIG. 45A shows representative FACS plots with frequencies of tdTomato expression in various spleen immune cell (CD45+, live) subsets, including total myeloid (CD11b+), B cells (CD19+), and T cells (TCR-B+) following treatment with LNPs formed with Lipid 10a-27 or 10a-26 or Lipid 10b-15. Ai9 mice injected with PBS represented background tdTomato fluorescence. FIG. 45B quantifies the proportion of myeloid cells, B cells, and T cells expressing tdTomato (mean+std. dev., n=3), which is equivalent to the proportion of each cell population which has been successfully transfected with Cre circular RNA. LNPs made with Lipids 10a-27 and 10a-26 exhibit significantly higher myeloid and T cell transfection compared with Lipid 93-S14, highlighting the improvements conferred by lipid structural modifications.

Figure 45C:
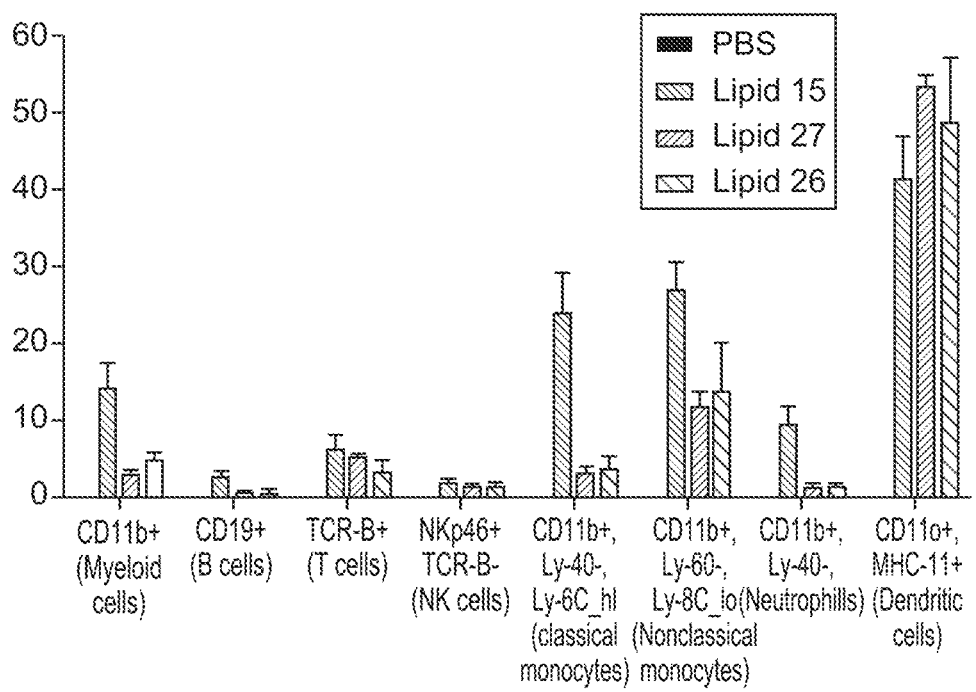
FIG. 45C illustrates the proportion of additional splenic immune cell populations, including NK cells, classical monocytes, nonclassical monocytes, neutrophils, and dendritic cells, expressing tdTomato after treatment with Lipids 27 and 26 (mean+std. dev., n=3).

FIG. 45C illustrates the proportion of additional splenic immune cell populations expressing tdTomato with Lipids 10a-27 and 10a-26 (mean+std. dev., n=3), which also include NK cells (NKp46+, TCR-B−), classical monocytes (CD11b+, Ly-6G-, Ly-6C_hi), nonclassical monocytes (CD11b+, Ly-6G-, Ly-6C_lo), neutrophils (CD11b+, Ly-6G+), and dendritic cells (CD11c+, MHC-II+). These experiments demonstrate that LNPs made with Lipids 10a-27 and 10a-26 and Lipid 10b-15 are effective at delivering circular RNAs to many splenic immune cell subsets in mice and lead to successful protein expression from the circular RNA in those cells.

Example 51

Example 51A: Built-In polyA Sequences and Affinity-Purification to Produce Immune-Silent Circular RNA PolyA sequences (20-30 nt) were inserted into the 5' and 3' ends of the RNA construct (precursor RNA with built-in polyA sequences in the introns). See, for example, FIG. 97A. Precursor RNA and introns can alternatively be polyadenylated post-transcriptionally using, e.g., *E. coli.* polyA polymerase or yeast polyA polymerase, which requires the use of an additional enzyme.

Figure 98:
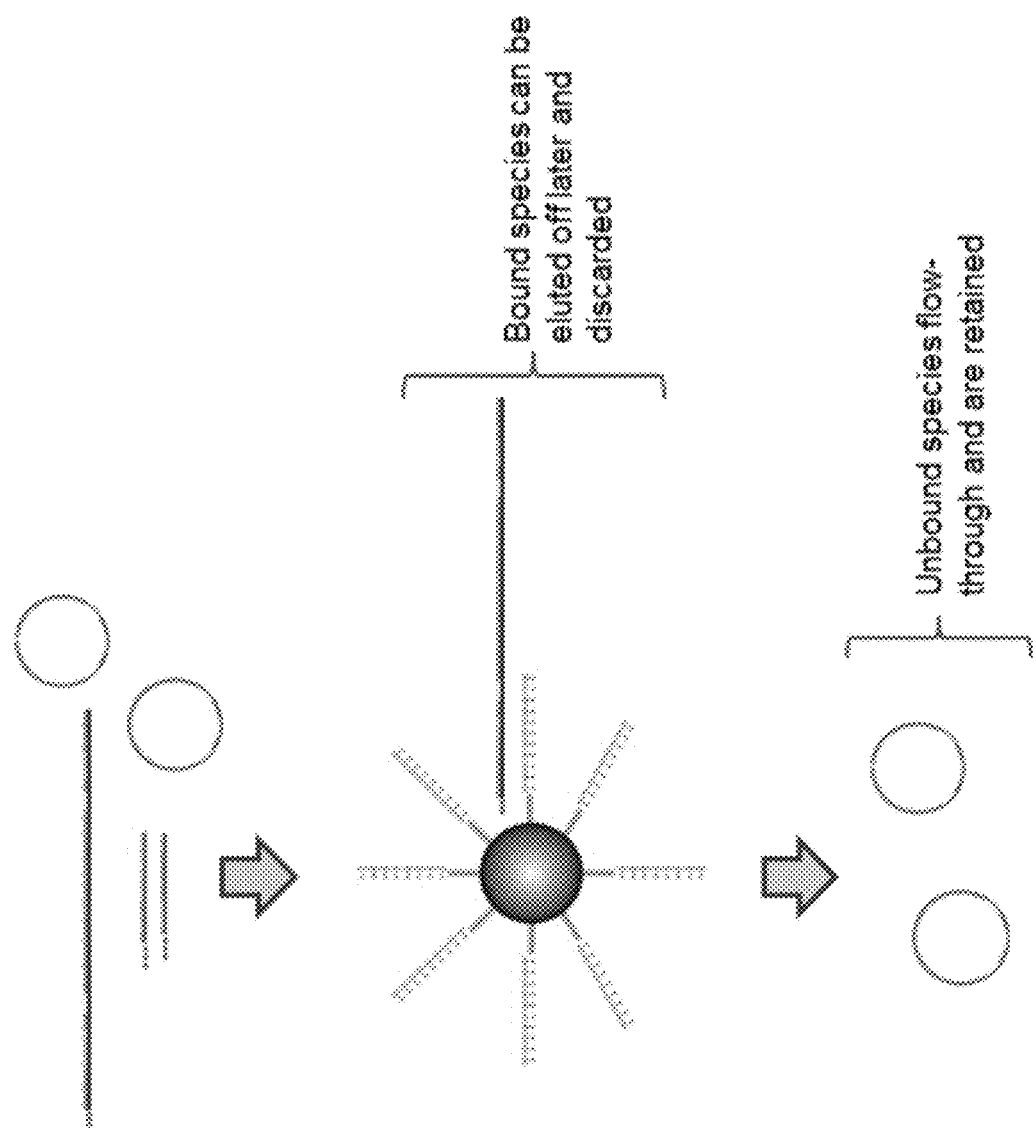
FIG. 98 depicts an exemplary negative selection purification method for circular RNA molecules such as oRNA. Oligonucleotides that are complementary to sequences present in the precursor RNA (such as the intron segments or external accessory regions) but not the oRNA are bound to a solid support, such as a bead conjugated to deoxythymidine oligonucleotides ("Oligo dT"; e.g., SEQ ID NO: 3779). oRNA preparations are washed over the bead; precursor RNA, partially spliced RNA, incomplete transcripts, and post-splicing intron segments bind to the oligonucleotide under certain buffer conditions while oRNA and nicked oRNA flow through. Flowthrough is collected for further processing.
Figure 99A:
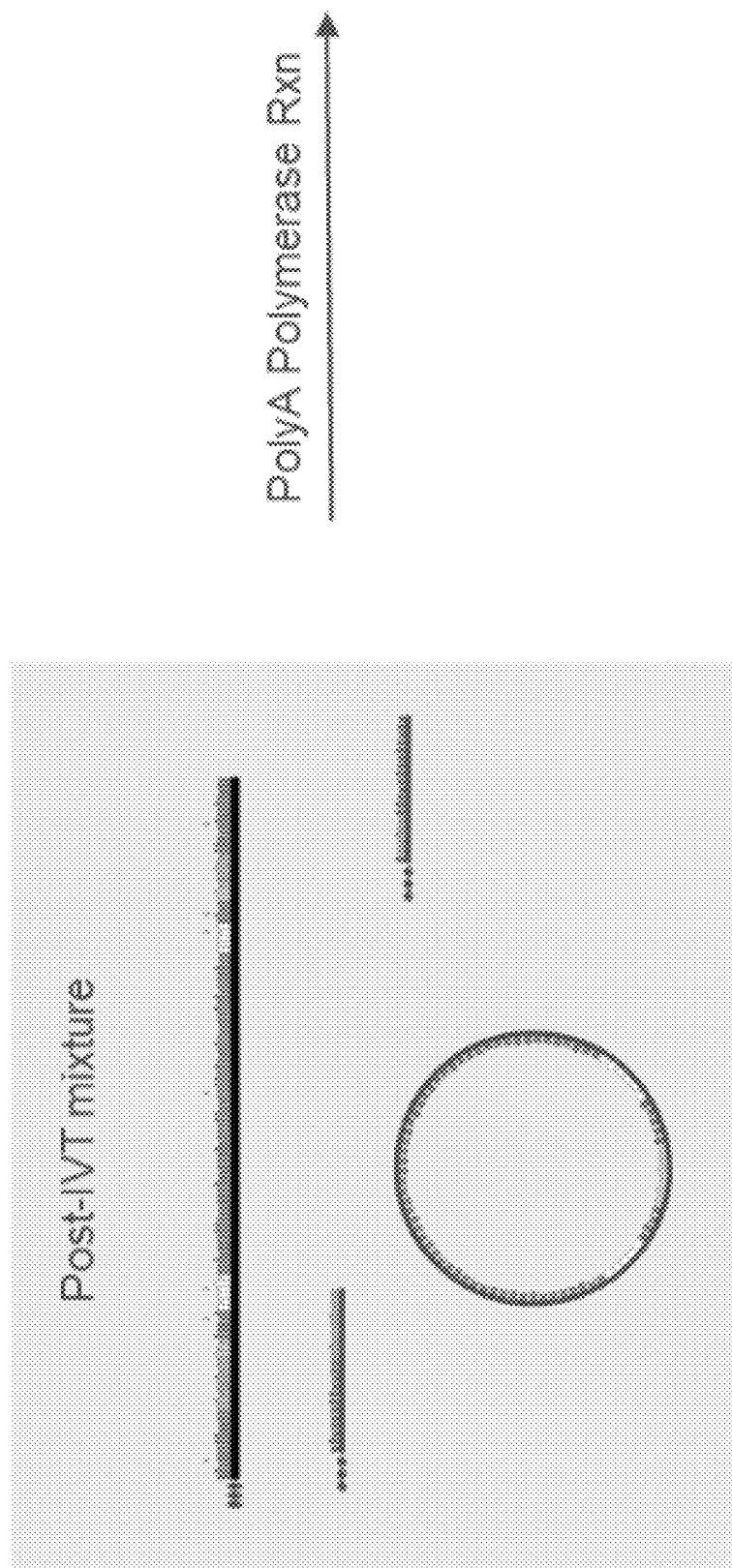
Figure 99A:
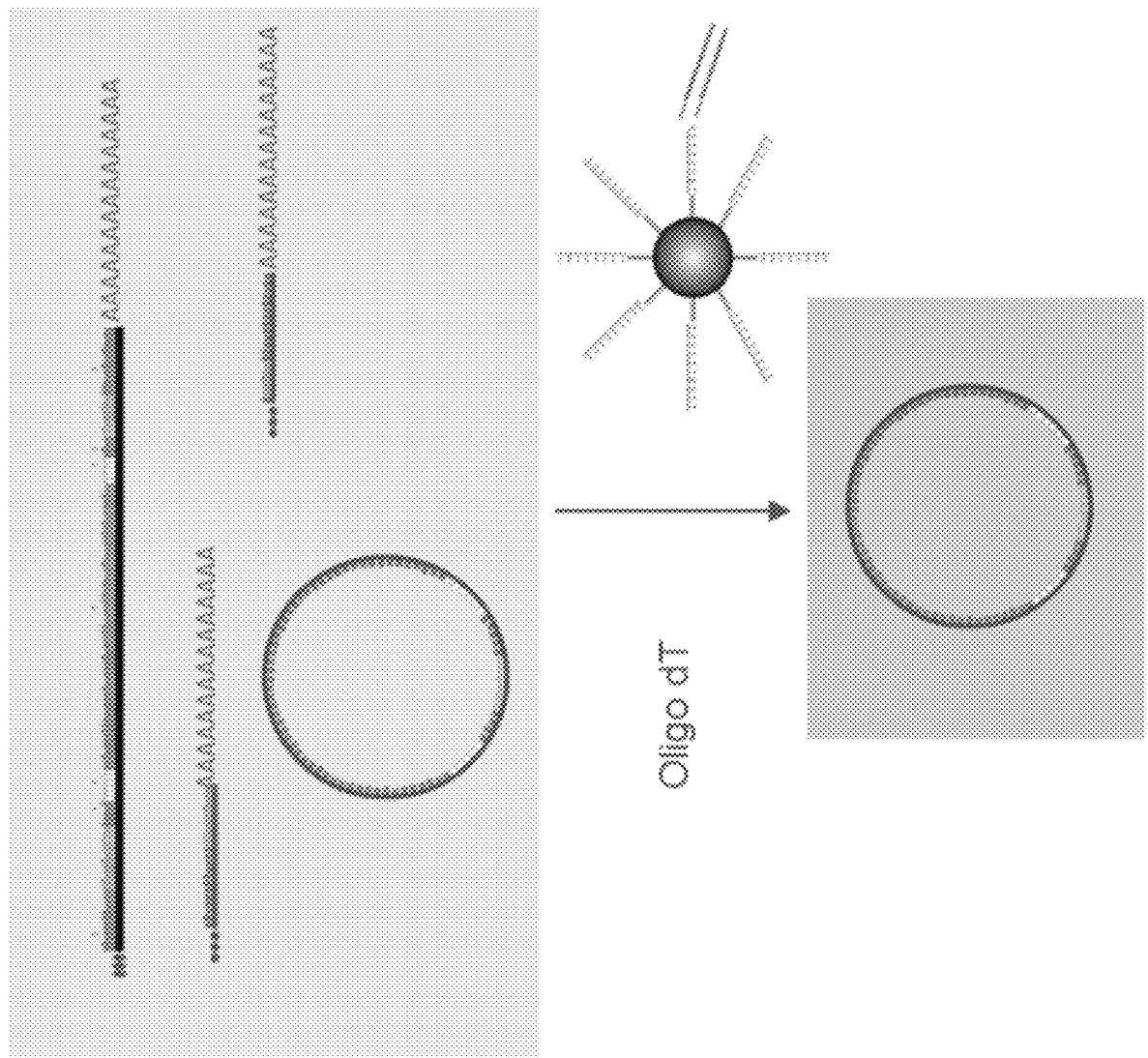
Figure 100A:
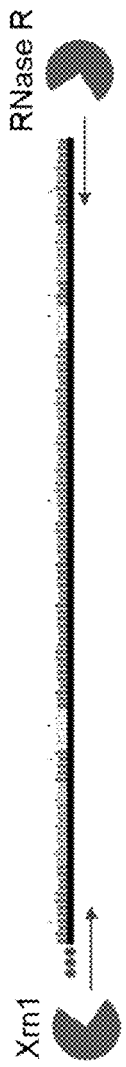
FIG. 100A and FIG. 100B depict an exemplary circular RNA enzymatic purification method. In this method, oRNA is synthesized by IVT in the presence of excess GMP and is autocatalytically spliced during the process. The resulting reaction products are digested with Xrn1 (a 5' to 3' exonuclease requiring a 5' terminal monophosphate) and RNase R (a 3' to 5' exonuclease) to remove non-circular RNA molecules.
Figure 100B:
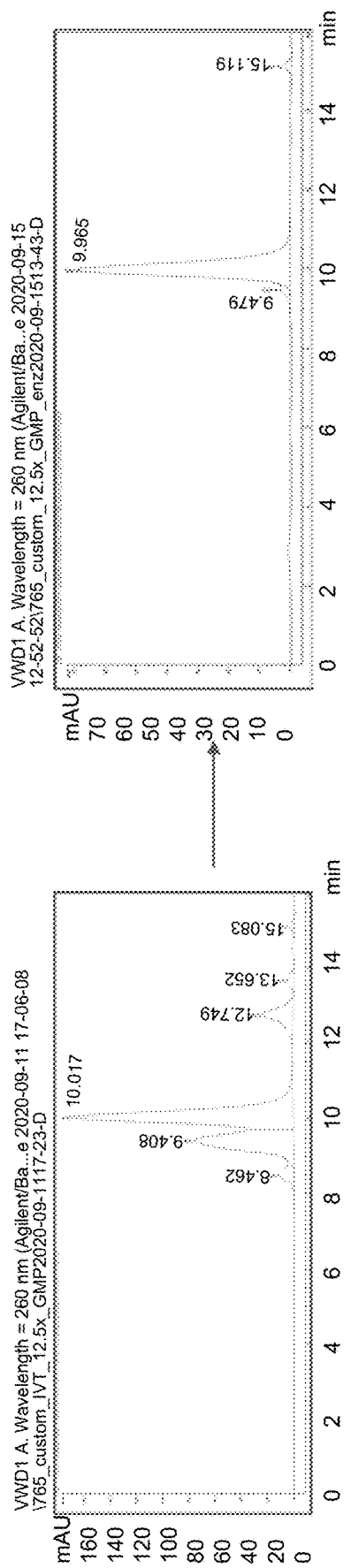

Circular RNA in this example was circularized by in vitro transcription (IVT) and affinity-purified by washing over a commercially available oligo-dT resin to selectively remove polyA-tagged sequences (including free introns and precursor RNA) from the splicing reaction. See, for example, FIG. 98. The IVT was performed with a commercial IVT kit (New England Biolabs) or a customerized IVT mix (Orna Therapeutics), containing guanosine monophosphate (GMP) and guanosine triphosphate (GTP) at different ratios (GMP:GTP=8, 12.5, or 13.75). In some embodiments, GMP at a high GMP:GTP ratio may be preferentially included as the first nucleotide, yielding a majority of monophosphate-capped precursor RNAs. As a comparison, the circular RNA product was alternatively purified by the treatment with Xrn1, Rnase R, and Dnase I (enzyme purification). See, for example, FIG. 100.

Immunogenicity of the circular RNAs prepared using the affinity purification or enzyme purification process were then assessed. Briefly, the prepared circular RNAs were transfected into A549 cells. After 24 hours, the cells were lysed and interferon beta-1 induction relative to mock samples was measured by qPCR. 3p-hpRNA, a triphosphorylated RNA, was used as a positive control.

Figure 46A:
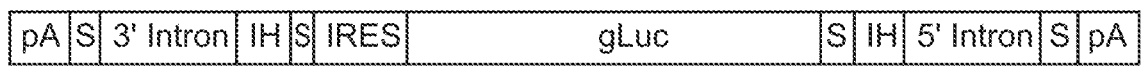
FIG. 46A depicts an exemplary RNA construct design with built-in polyA sequences in the introns.
Figure 46B:
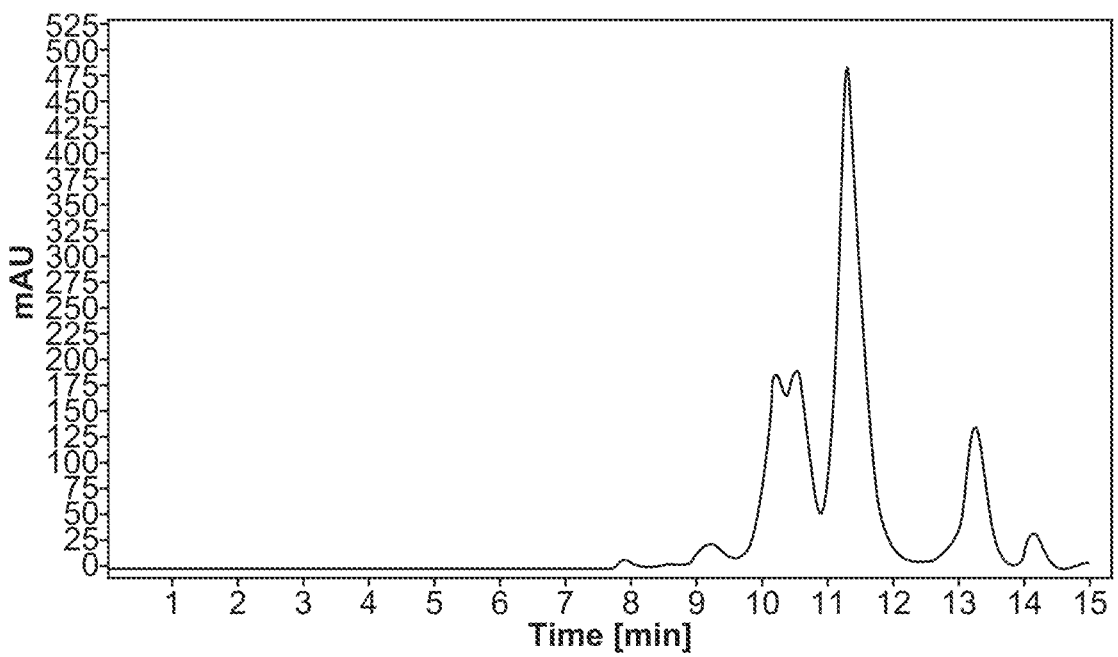
FIG. 46B shows the chromatography trace of unpurified circular RNA.
Figure 46C:
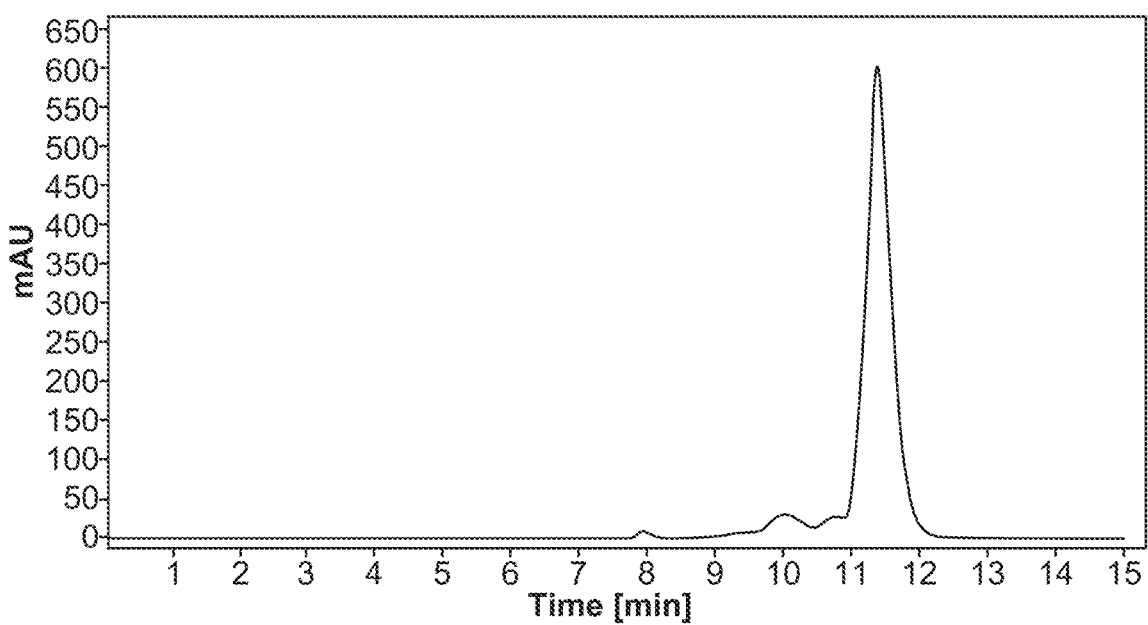
FIG. 46C shows the chromatography trace of affinity-purified circular RNA.
Figure 46D:
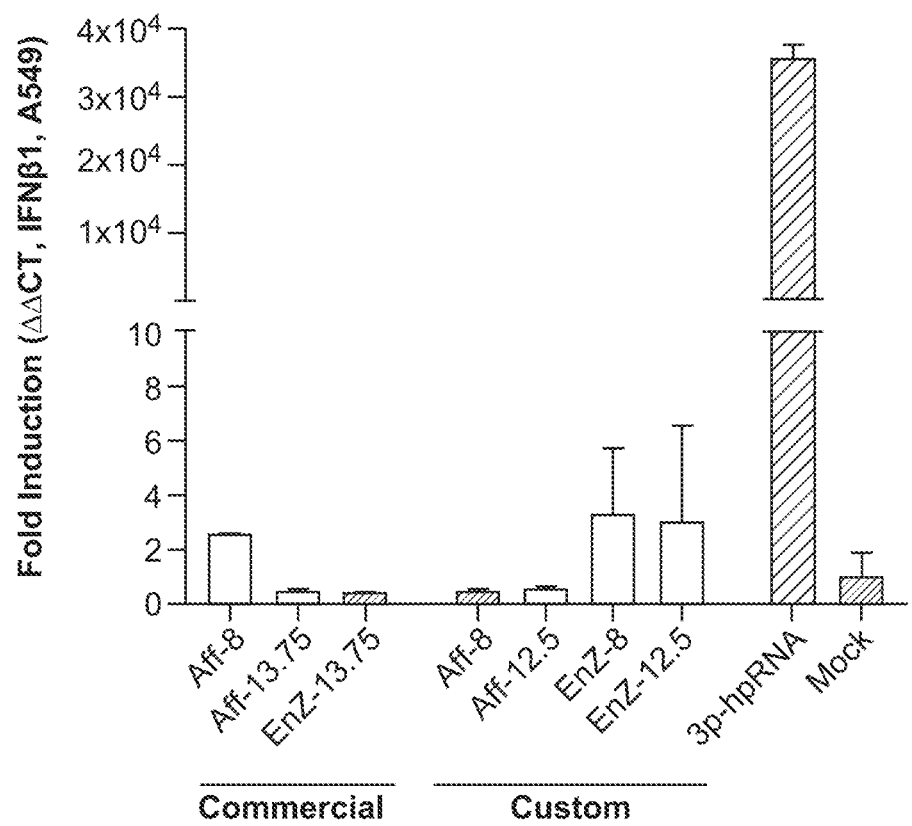
FIG. 46D shows the immunogenicity of the circular RNAs prepared with varying in vitro transcription (IVT) conditions and purification methods. (Commercial=commercial IVT mix; Custom=customerized IVT mix; Aff=affinity purification; Enz=enzyme purification; GMP:GTP ratio=8, 12.5, or 13.75).

FIGS. 46B and 46C and FIGS. 99A and 99B show that the negative selection affinity purification removes non-circular products from splicing reactions when polyA sequences (e.g., SEQ ID NO: 3778) are included on elements that are removed during splicing and present in unspliced precursor molecules. FIG. 46D shows circular RNAs prepared with tested IVT conditions and purification methods are all immunoquiescent. These results suggest the negative selection affinity purification is equivalent or superior to enzyme purification for circular RNA purification and that customized circular RNA synthesis conditions (IVT conditions) may reduce the reliance on GMP excess to achieve maximal immunoquiescence.

Figure 47A:
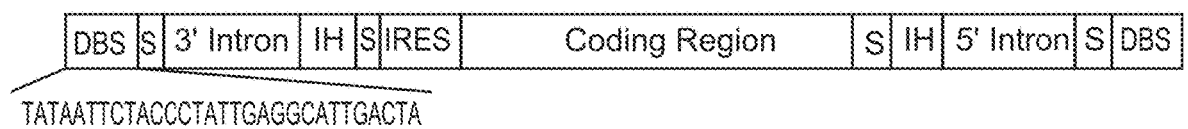
FIG. 47A depicts an exemplary RNA construct design with a dedicated binding sequence of TATAATTCTACCC-TATTGAGGCATTGACTA (SEQ ID NO: 3667) as an alternative to polyA for hybridization purification.

Example 51B: Dedicated Binding Site and Affinity-Purification for Circular RNA Production Instead of polyA tags, one can include specifically design sequences (DBS, dedicated binding site). See, for example, FIG. 47A.

Instead of a polyA tag, a dedicated binding site (DBS), such as a specifically designed complementary oligonucleotide that can bind to a resin, may be used to selectively deplete precursor RNA and free introns. In this example, DBS sequences (30 nt) were inserted into the 5' and 3' ends of the precursor RNA, such as TATAATTCTACCCTATT-GAGGCATTGACTA (SEQ ID NO: 3667), shown in FIG. 47A. RNA was transcribed and the transcribed product was washed over a custom complementary oligonucleotide linked to a resin.

Figure 47B:
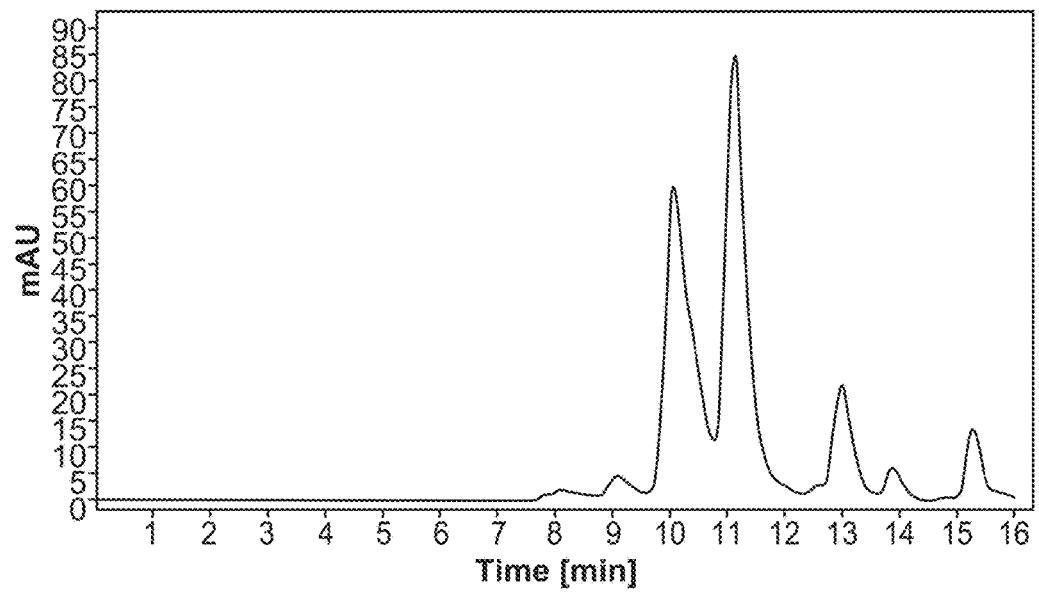
FIG. 47B shows the chromatography trace of unpurified circular RNA.
Figure 47C:
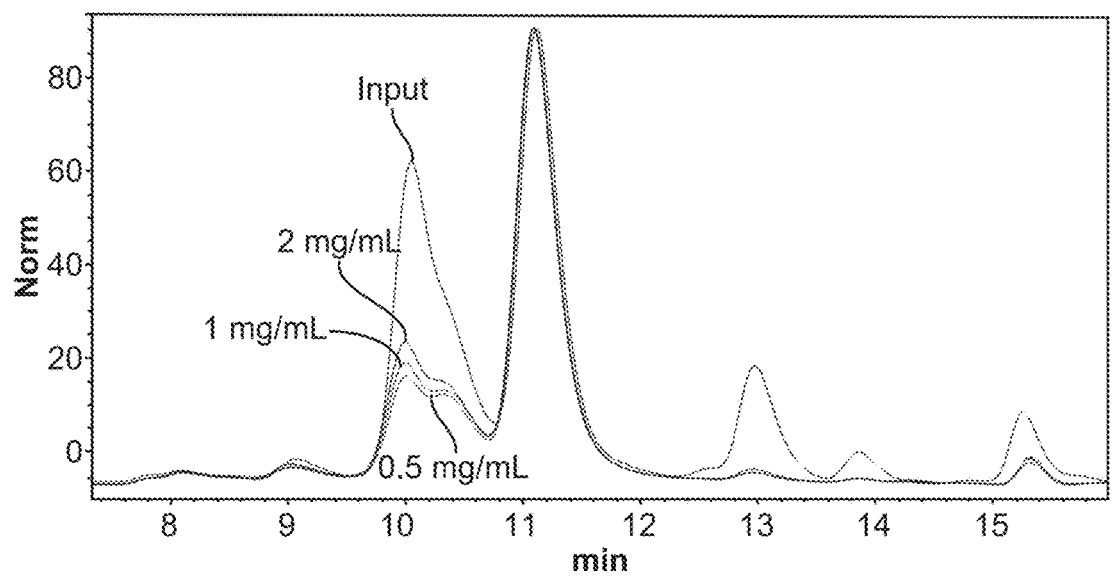
FIG. 47C shows the chromatography trace of affinity-purified circular RNA.

FIGS. 47B and 47C demonstrates that including the designed DBS sequence in elements that are removed during splicing enables the removal of unspliced precursor RNA and free intron components in a splicing reaction, via negative affinity purification.

Example 51C: Production of a Circular RNA Encoding Dystrophin

Figure 48A:
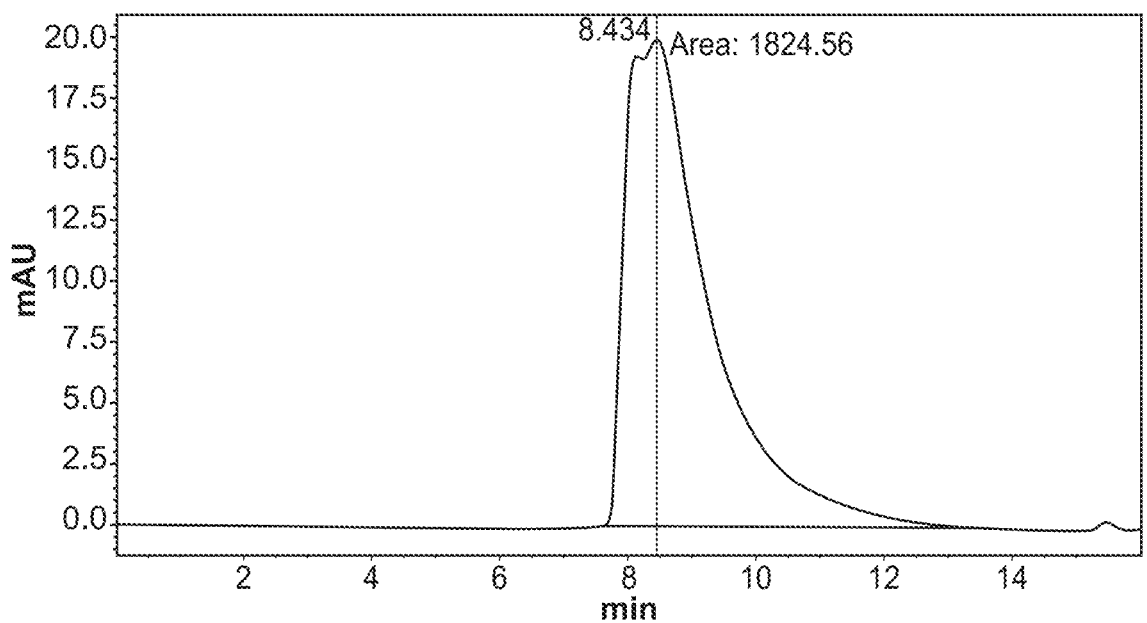
FIG. 48A shows the chromatography trace of unpurified circular RNA encoding dystrophin.
Figure 48B:
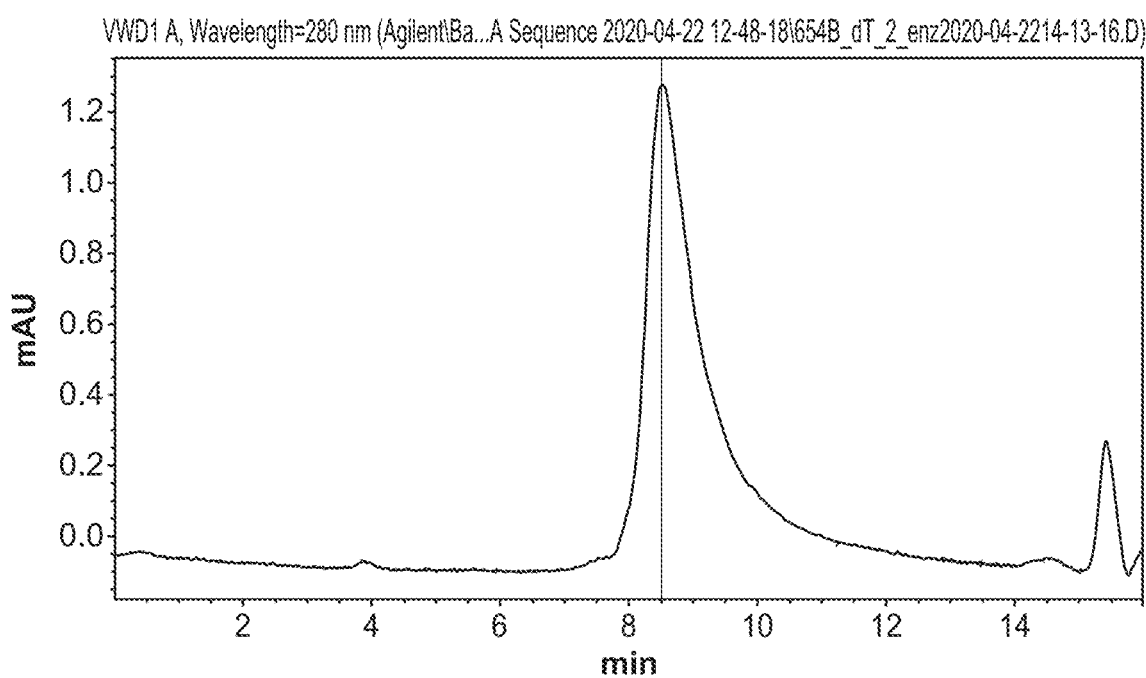
FIG. 48B shows the chromatography trace of enzyme-purified circular RNA encoding dystrophin.

A 12 kb 12,000 nt circular RNA encoding dystrophin was produced by in vitro transcription of RNA precursors followed by enzyme purification using a mixture of Xrn1, DNase 1, and RNase R to degrade remaining linear components. FIG. 48 shows that the circular RNA encoding dystrophin was successfully produced.

Example 51D: Negative Selection Affinity-Purification of Circular RNA

Affinity sequences are added to precursor RNAs, and circular RNA is produced by in vitro transcription (IVT), as described in Examples 51A and 51B. Oligonucleotides comprising a sequence that is 100% complementary to the affinity sequences are conjugated to a resin, or a commercially available resin conjugated to oligonucleotides complementary to the affinity sequences is obtained. The IVT reaction mixture may be directly added to the resin. Alternatively, the IVT reaction solution is buffer exchanged into binding buffer, such as a Tris buffer, comprising greater than 1 mM one or more monovalent salts, such as NaCl or KCl, or the one or more monovalent salts are simply added to the IVT reaction mixture before the IVT reaction mixture is added to the resin. Circular RNA that does not comprise an affinity sequence is then affinity-purified by washing the solution comprising linear RNA and circular RNA over the resin. The solution may be heated during this process in order to denature aberrantly hybridized sequences. The eluent from the beads is collected and buffer exchanged into water or storage buffer comprising 1 mM sodium citrate, pH 6.5, using a filtration threshold of 10-300 kDa.

Example 52

5' Spacer Between 3' Intron Fragment and the IRES Improves Circular RNA Expression Expression level of purified circRNAs with different 5' spacers between the 3' intron fragment and the IRES in Jurkat cells were compared. Briefly, luminescence from secreted *Gaussia* luciferase in supernatant was measured 24 hours after electroporation of 60,000 cells with 250 ng of each RNA.

Additionally, stability of purified circRNAs with different 5' spacers between the 3' intron fragment and the IRES in Jurkat cells were compared. Briefly, luminescence from secreted *Gaussia* luciferase in supernatant was measured over 2 days after electroporation of 60,000 cells with 250 ng of each RNA and normalized to day 1 expression.

Figure 49A:
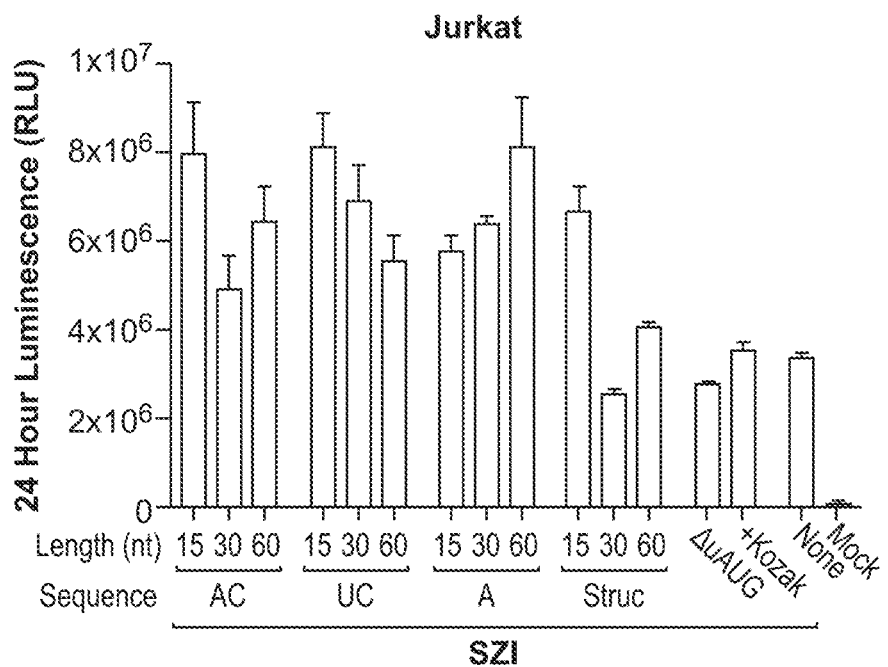
FIGS. 49A and 49B compare the expression (FIG. 49A) and stability (FIG. 49B) of purified circRNAs with different 5' spacers between the 3' intron fragment/5' internal duplex region and the IRES in Jurkat cells. (AC=only A and C were used in the spacer sequence; UC=only U and C were used in the spacer sequence.)
Figure 49B:
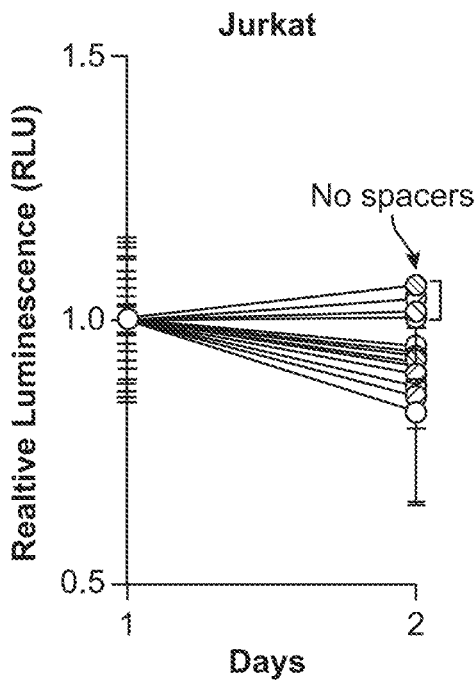

The results are shown in FIGS. 49A and 49B, indicating that adding a spacer can enhance IRES function and the importance of sequence identity and length of the added spacer. A potential explanation is that the spacer is added right before the IRES and likely functions by allowing the IRES to fold in isolation from other structured elements such as the intron fragments.

Example 53

This example describes deletion scanning from 5' or 3' end of the caprine kobuvirus IRES. IRES borders are generally poorly characterized and require empirical analysis, and this example can be used for locating the core functional sequences required for driving translation. Briefly, circular RNA constructs were generated with truncated IRES elements operably linked to a *gaussia* luciferase coding sequence. The truncated IRES elements had nucleotide sequences of the indicated lengths removed from the 5' or 3' end. Luminescence from secreted *gaussia* luciferase in supernatant was measured 24 and 48 hours after electroporation of primary human T cells with RNA. Stability of expression was calculated as the ratio of the expression level at the 48-hour time point relative to that at the 24-hour time point.

Figure 50:
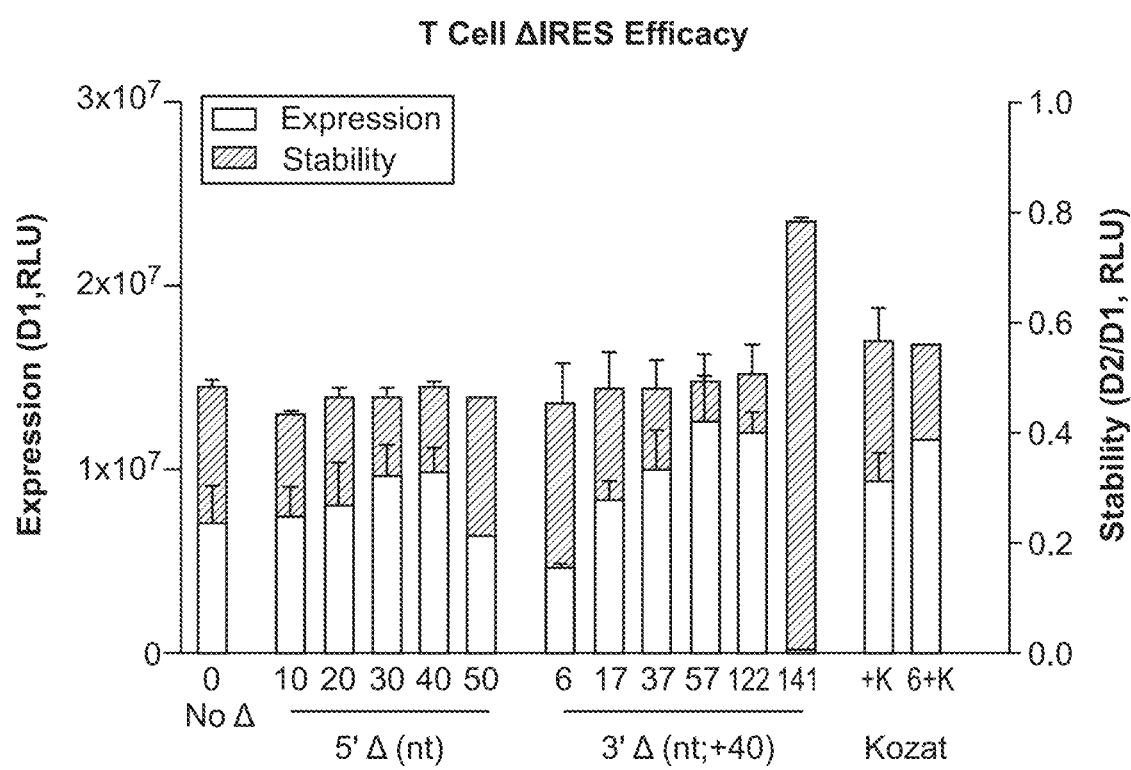
FIG. 50 shows luminescence expression levels and stability of expression in primary T cells from circular RNAs containing the original or modified IRES elements indicated.

As shown in FIG. 50, deletion of more than 40 nucleotides from the 5' end of the IRES reduced expression and disrupted IRES function. Stability of expression was relatively unaffected by the truncation of the IRES element but expression level was substantially reduced by deletion of 141 nucleotides from the 3' end of the IRES, whereas deletion of 57 or 122 nucleotides from the 3' end had a positive impact on the expression level.

It was also observed that deletion of the 6-nucleotide pre-start sequence reduced the expression level of the luciferase reporter. Replacement of the 6-nucleotide sequence with a classical kozak sequence (GCCACC) did not have a significant impact but at least maintained expression.

Example 54

This example describes modifications (e.g., truncations) of selected IRES sequences, including Caprine Kobuvirus (CKV) IRES, Parabovirus IRES, Apodemus Picornavirus (AP) IRES, Kobuvirus SZAL6 IRES, Crohivirus B (CrVB) IRES, CVB3 IRES, and SAFV IRES. The sequences of the IRES elements are provided in SEQ ID NOs: 348-389. Briefly, circular RNA constructs were generated with truncated IRES elements operably linked to a *gaussia* luciferase coding sequence. HepG2 cells were transfected with the circular RNAs. Luminescence in the supernatant was assessed 24 and 48 hours after transfection. Stability of expression was calculated as the ratio of the expression level at the 48-hour time point relative to that at the 24-hour time point.

Figure 51:
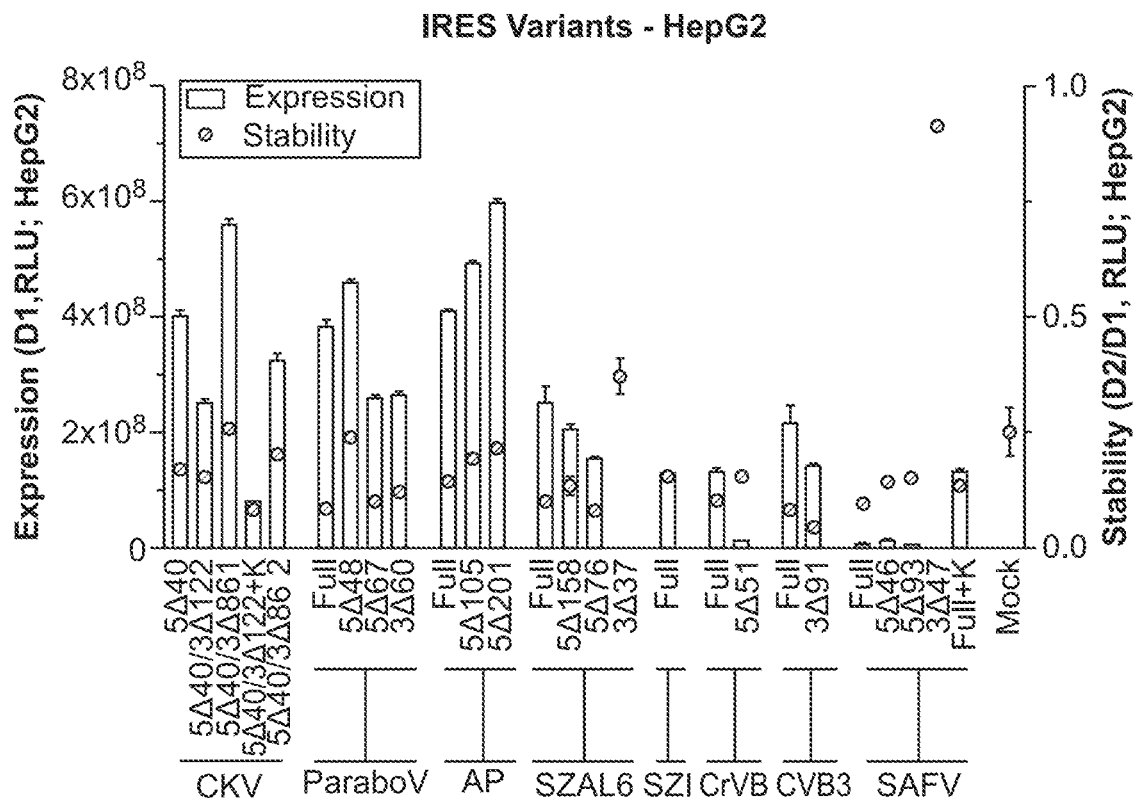
FIG. 51 shows luminescence expression levels and stability of expression in HepG2 cells from circular RNAs containing the original or modified IRES elements indicated.

As shown in FIG. 51, truncations had variable effects depending on the identity of the IRES, which may depend on the initiation mechanism and protein factors used for translation, which often differs between IRESs. 5' and 3' deletions can be effectively combined, for example, in the context of CKV IRES. Addition of a canonical Kozak sequence in some cases significantly improved expression (as in SAFV, Full vs Full+K) or diminished expression (as in CKV, 5d40/3d122 vs 5d40/3d122+K).

Example 55

This example describes modifications of CK-739, AP-748, and PV-743 IRES sequences, including mutations altative translation initiation sites. Briefly, circular RNA constructs were generated with modified IRES elements operably linked to a *gaussia* luciferase coding sequence. Luminescence from secreted *gaussia* luciferase in supernatant was measured 24 and 48 hours after transfection of 1C1C7 cells with RNA.

Figure 52:
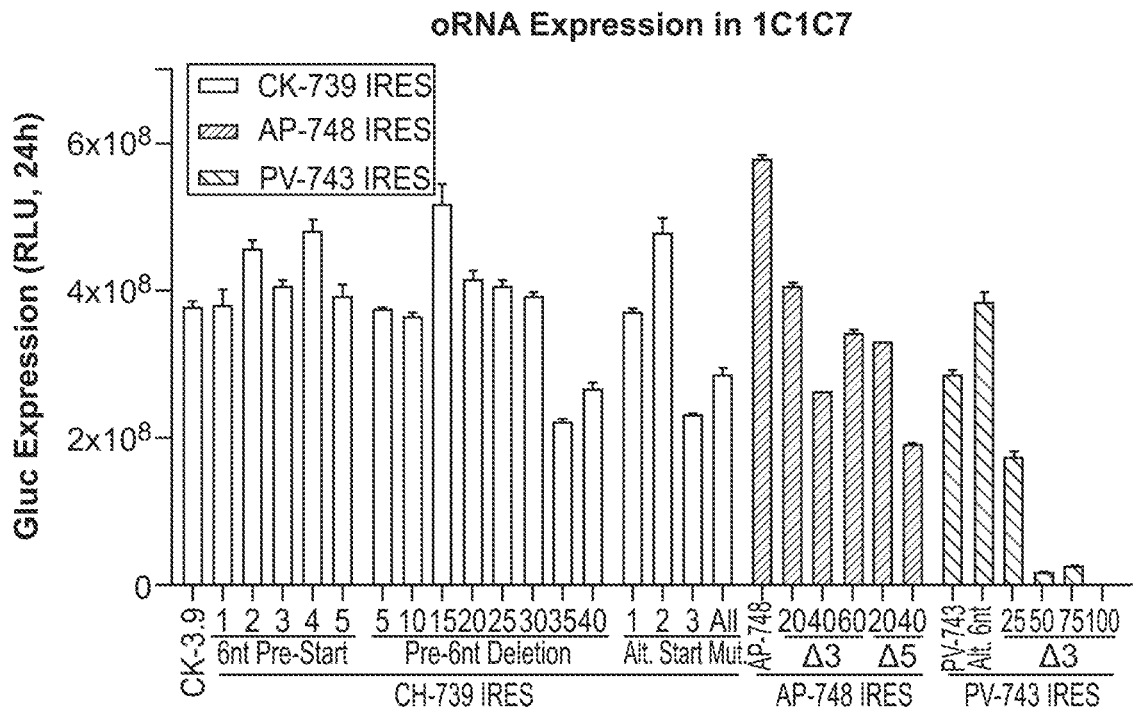
FIG. 52 shows luminescence expression levels and stability of expression in 1C1C7 cells from circular RNAs containing the original or modified IRES elements indicated.

CUG was the most commonly found alternative start site but many others were also characterized. These triplets can be present in the IRES scanning tract prior to the start codon and can affect translation of correct polypeptides. Four alternative start site mutations were created, with the IRES sequences provided in SEQ ID NOs: 378-380. As shown in FIG. 52, mutations of alternative translation initiation sites in the CK-739 IRES affected translation of correct polypeptides, positively in some instances and negatively in other instances. Mutation of all the alternative translation initiation sites reduced the level of translation.

Alternative Kozak sequences, 6 nucleotides before start codon, can also affect expression levels. The 6-nucleotide sequence upstream of the start codon were gTcacG, aaagtc, gTcacG, gtcatg, gcaaac, and acaacc, respectively, in CK-739 IRES and Sample Nos. 1-5 in the "6 nt Pre-Start" group. As shown in FIG. 52, substitution of certain 6-nucleotide sequences prior to the start codon affected translation.

It was also observed that 5' and 3' terminal deletions in AP-748 and PV-743 IRES sequences reduced expression.

However, in the CK-739 IRES, which had a long scanning tract, translation was relatively unaffected by deletions in the scanning tract.

Example 56

This example describes modifications of selected IRES sequences by inserting 5' and/or 3' untranslated regions (UTRs) and creating IRES hybrids. Briefly, circular RNA constructs were generated with modified IRES elements operably linked to a *gaussia* luciferase coding sequence. Luminescence from secreted *gaussia* luciferase in supernatant was measured 24 and 48 hours after transfection of HepG2 cells with RNA.

Figure 53:
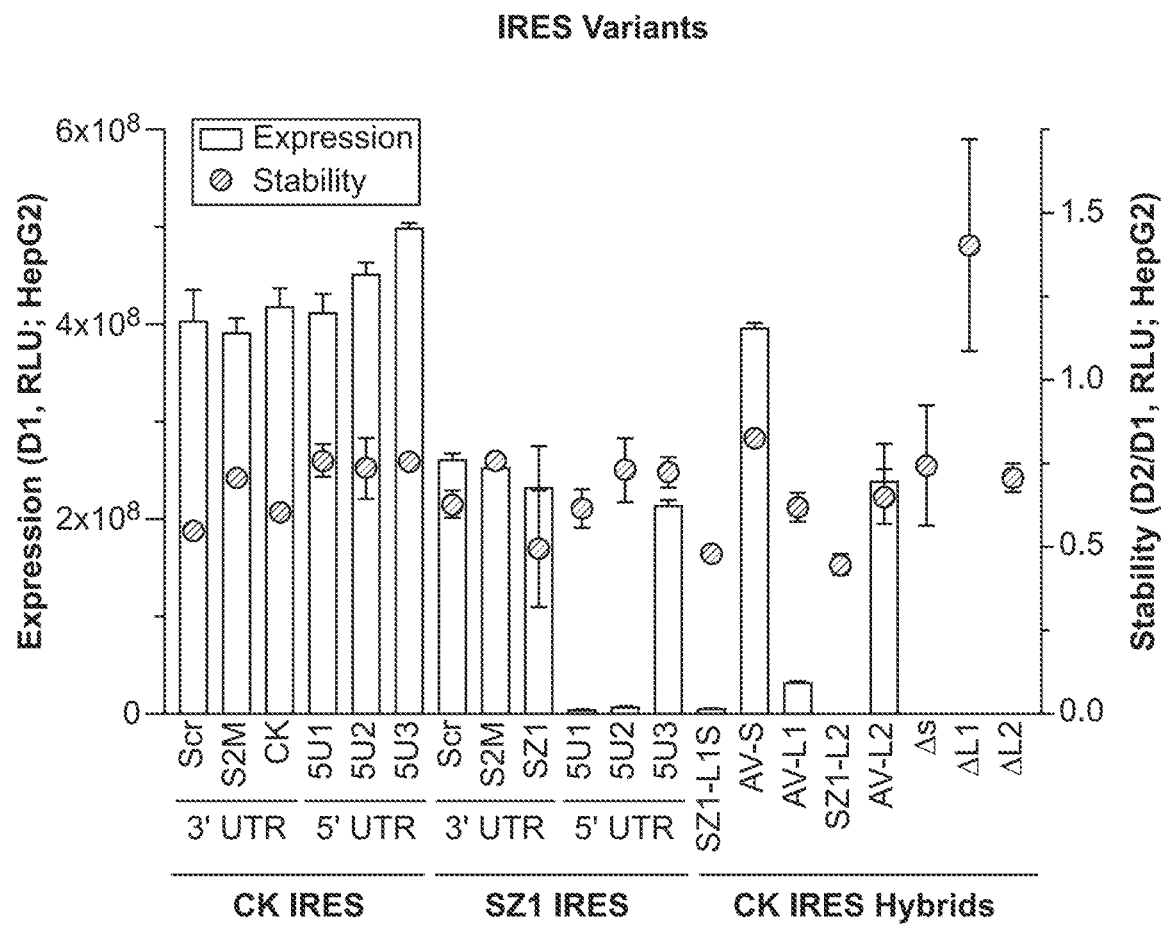
FIG. 53 shows luminescence expression levels and stability of expression in HepG2 cells from circular RNAs containing IRES elements with untranslated regions (UTRs) inserted or hybrid IRES elements. "Scr" means Scrambled, which was used as a control.

IRES sequences with UTRs inserted are provided in SEQ ID NOs: 390-401. As shown in FIG. 53, insertion of 5' UTR right after the 3' end of the IRES and before the start codon slightly increased the translation from Caprine Kobuvirus (CK) IRES but in some instances abrogated translation from Salivirus SZ1 IRES. Insertion of 3' UTR right after the stop cassette had no impact on both IRES sequences.

Hybrid CK IRES sequences are provided in SEQ ID NOs: 390-401. CK IRES was used as a base, and specific regions of the CK IRES were replaced with similar-looking structures from other IRES sequences, for example, SZ1 and AV (Aichivirus). As shown in FIG. 53, certain hybrid synthetic IRES sequences were functional, indicating that hybrid IRES can be constructed using parts from distinct IRES sequences that show similar predicted structures while deleting these structures completely abrogates IRES function.

Example 57

This example describes modifications of circular RNAs by introducing stop codon or cassette variants. Briefly, circular RNA constructs were generated with IRES elements operably linked to a *gaussia* luciferase coding sequence followed by variable stop codon cassettes, which included a stop codon in each frame and two stop codons in the reading frame of the *gaussia* luciferase coding sequence. 1C1C7 cells were transfected with the circular RNAs. Luminescence in supernatant was assessed 24 and 48 hours after transfection.

Figure 54:
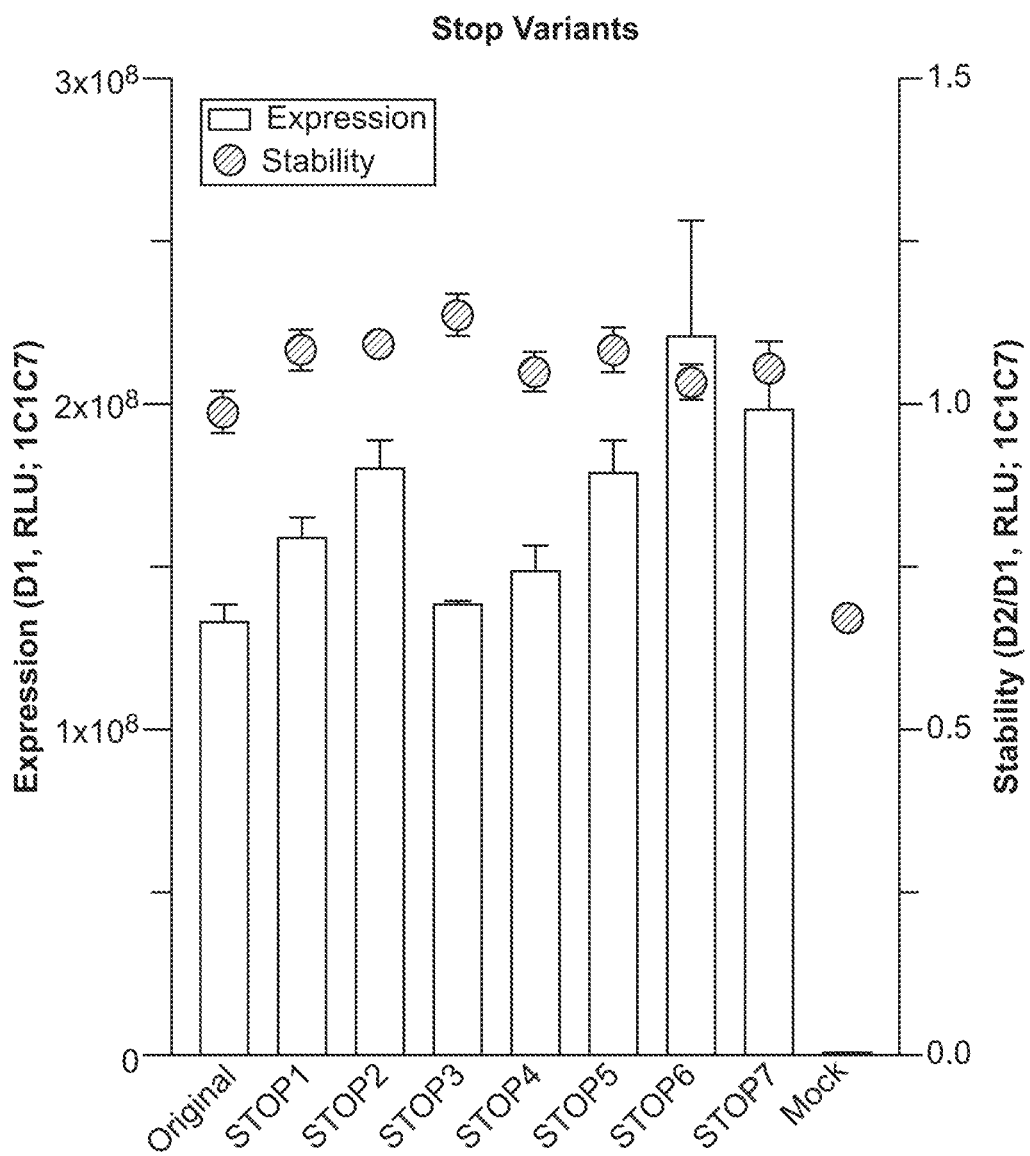
FIG. 54 shows luminescence expression levels and stability of expression in 1C1C7 cells from circular RNAs containing an IRES and variable stop codon cassettes operably linked to a *Gaussia* luciferase coding sequence.

The sequences of the stop codon cassettes are set forth in SEQ ID NOs: 3600-3606. As shown in FIG. 54, certain stop codon cassettes improved expression levels, although they had little impact on expression stability. In particular, a stop cassette with two frame 1 (the reading frame of the *gaussia* luciferase coding sequence) stop codons, the first being TAA, followed by a frame 2 stop codon and a frame 3 stop codon, is effective for promoting functional translation.

Example 58

This example describes modifications of circular RNAs by inserting 5' UTR variants. Briefly, circular RNA constructs were generated with IRES elements with 5' UTR variants inserted between the 3' end of the IRES and the start codon, the IRES being operably linked to a *gaussia* luciferase coding sequence. 1C1C7 cells were transfected with the circular RNAs. Luminescence in supernatant was assessed 24 and 48 hours after transfection.

Figure 55:
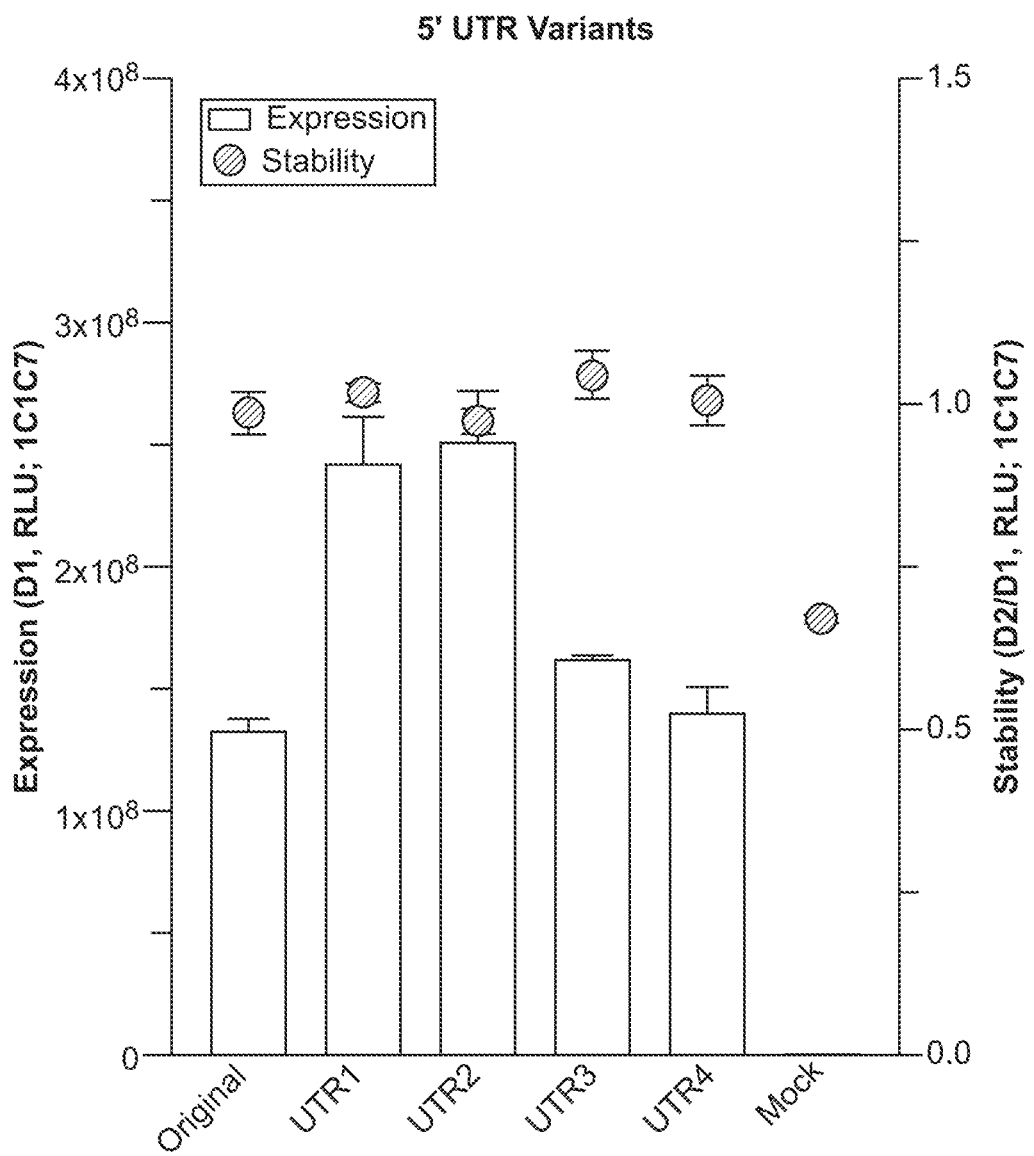
FIG. 55 shows luminescence expression levels and stability of expression in 1C1C7 cells from circular RNAs containing an IRES and variable untranslated regions (UTRs) inserted before the start codon of a gaussian luciferase coding sequence.

The sequences of the 5' UTR variants are set forth in SEQ ID NOs: 3596-3599. As shown in FIG. 55, a CK IRES with a canonical Kozak sequence (UTR4) was more effective when a 36-nucleotide unstructured/low GC spacer sequence was added (UTR2), suggesting that the GC-rich Kozak sequences may interfere with core IRES folding. Using a higher-GC/structured spacer with a kozak sequence did not show the same benefit (UTR3), possibly due to interference with IRES folding by the spacer itself. Mutating the kozak sequence to gTcacG (UTR1) enhanced translation to the same level as the Kozak+spacer alternative without the need for a spacer.

Example 59

This example describes the impact of miRNA target sites in circular RNAs on expression levels. Briefly, circular RNA constructs were generated with IRES elements operably linked to a human erythropoietin (hEPO) coding sequence, where 2 tandem miR-122 target sites were inserted into the construct. miR-122-expressing Huh7 cells were transfected with the circular RNAs. hEPO expression in supernatant was assessed 24 and 48 hours after transfection by sandwich ELISA.

Figure 56:
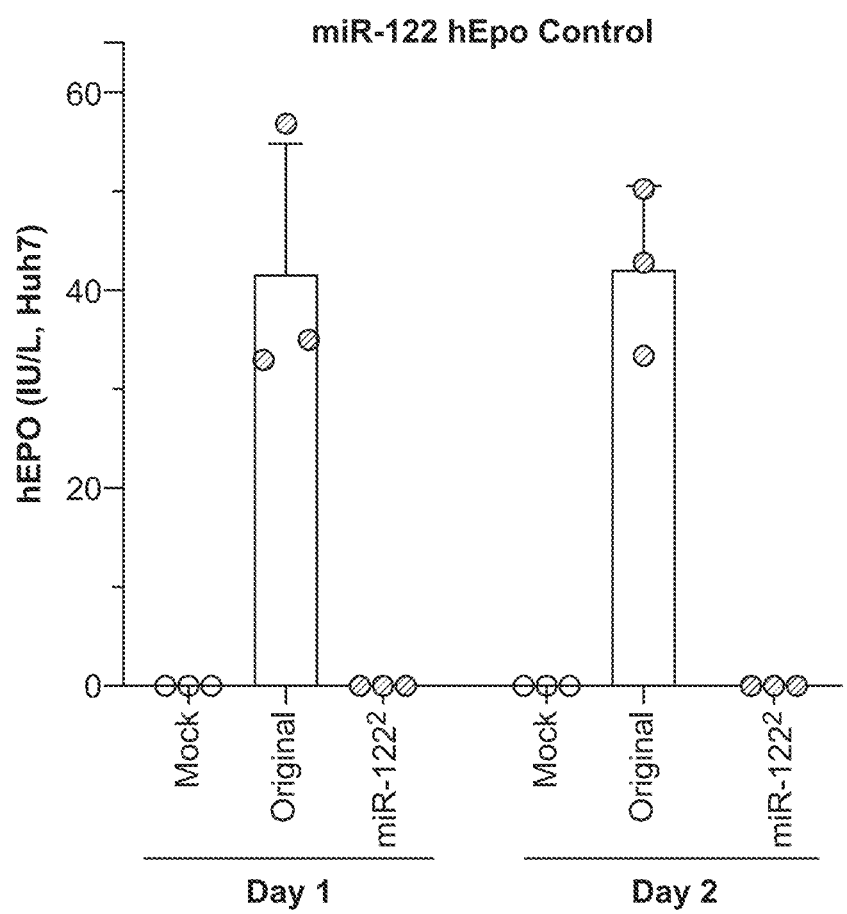
FIG. 56 shows expression levels of human erythropoietin (hEPO) in Huh7 cells from circular RNAs containing two miR-122 target sites downstream from the hEPO coding sequence.

As shown in FIG. 56, the hEPO expression level was obrogated where the miR-122 target sites were inserted into the circular RNA. This result demonstrates that expression from circular RNA can be regulated by miRNA. As such, cell type- or tissue-specific expression can be achieved by incorporating target sites of the miRNAs expressed in the cell types in which expression of the recombinant protein is undesirable.

Example 60

Figure 57:
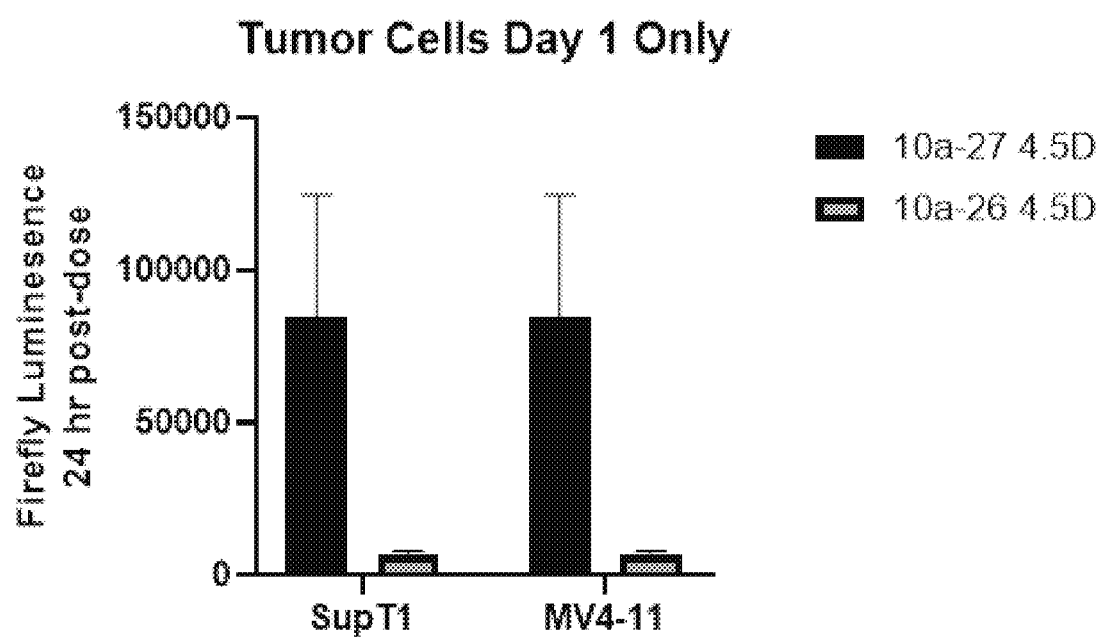
FIG. 57 shows luminescence expression levels in SupT1 cells (from a human T cell tumor line) and MV4-11 cells (from a human macrophage line) from LNPs transfected with circular RNAs encoding for Firefly luciferase in vitro.

This example shows transfection of human tumor cells by LNPs in vitro. SupT1 cells (a human T cell tumor line) and MV4-11 cells (a human macrophage tumor line) were plated at 100,000 cells/well and 100,000 cells/well, respectively, in a 96-well plate overnight. Then, LNPs containing circRNA coding for Firefly Luciferase (FLuc) were added to the cells at 200 ng RNA/well. After 24-hour incubation, luminescence was quantified using the Bright-Glo Luciferase Assay System (Promega) according to manufacturer's instructions and background luminescence from cells not treated with LNP was subtracted. FIG. 57 quantifies the measured Firefly luminescence, indicating that LNPs comprising Lipid 10a-27 (10a-27 (4.5D) LNP, see Example 70) or Lipid 10a-26 (10a-26 (4.5D) LNP, see Example 70) can transfect and express circRNA in both human T cell and macrophage tumor lines in vitro. 10a-27 (4.5D) LNP resulted in higher luminescence than 10a-26 (4.5D) LNP showing that levels of transfection of LNPs to human tumor cells can be affected by formulation.

Example 61

Figure 58:
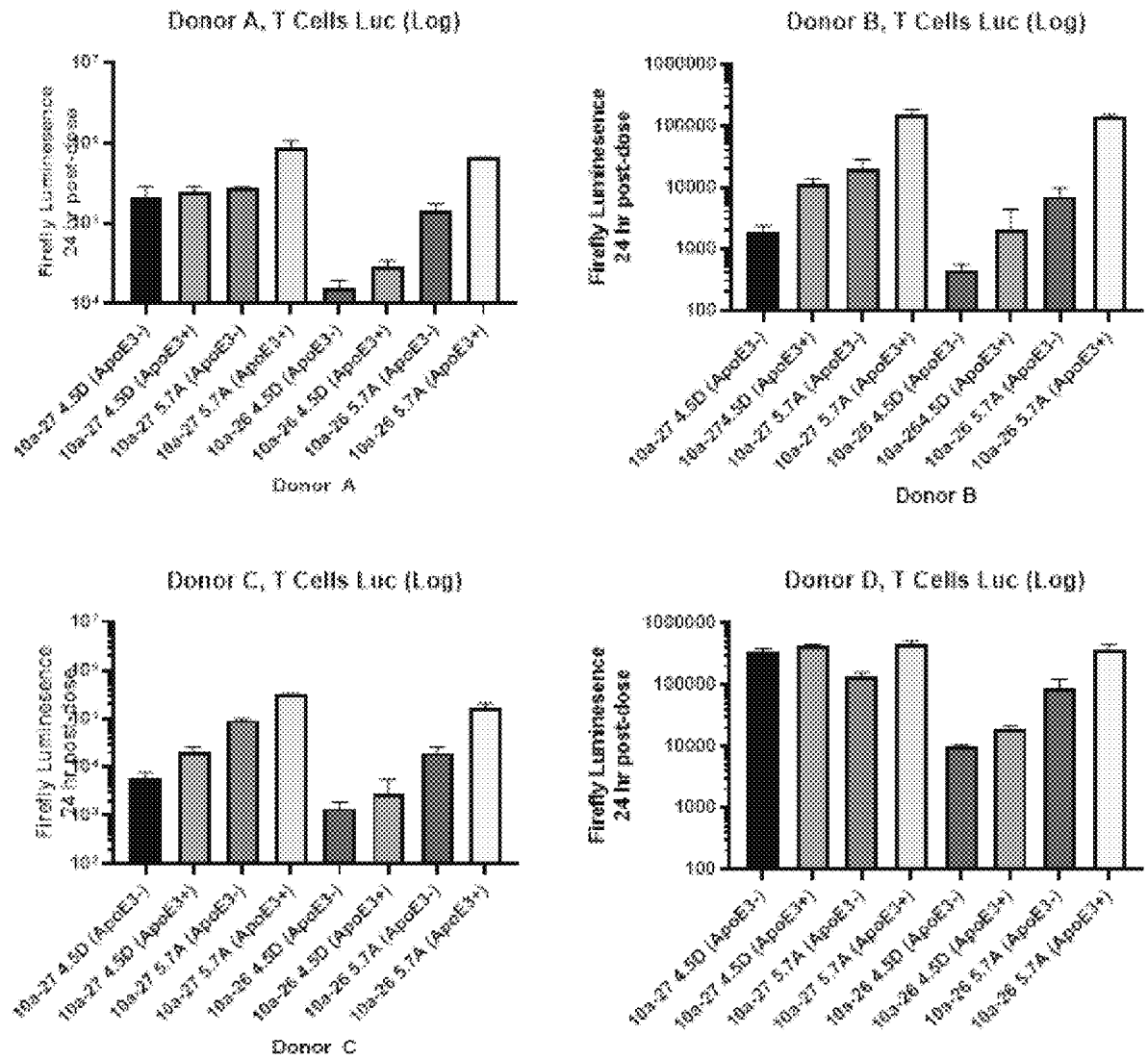
FIG. 58 shows a comparison of transfected primary human T cells LNPs containing circular RNAs dependency of ApoE based on the different helper lipid, PEG lipid, and ionizable lipid:phosphate ratio formulations.

This example shows transfection of primary human activated T cells in vitro. Primary human T cells from independent donors were stimulated with aCD3/aCD28 and allowed to proliferate for 6 days in the presence of human serum and IL-2. Then, 100,000 cells were plated in a 96 well plate and LNPs containing circRNA coding for Firefly Luciferase (FLuc) were added to the cells at 200 ng RNA/well with or without Apolipoprotein E3 (ApoE3). After 24-hour incubation, luminescence was quantified using the Bright-Glo Luciferase Assay System (Promega) according to manufacturer's instructions and background luminescence from cells not treated with LNPs was subtracted. FIG. 58 shows the measured Firefly luminescence across 4 independent donors, demonstrating that all LNPs tested transfect primary human T cells in vitro. LNPs containing Lipid 10a-27 generally produced higher luminescence than those containing Lipid 10a-26. Furthermore, the addition of ApoE3 generally increased the expression of luciferase more for 10a-27 (5.7A) and 10a-26 (5.7A) (average of 4.4-fold and 9.3-fold across 4 donors, respectively) compared to 10a-27 (4.5D) and 10a-26 (4.5D) (3.1-fold and 2.6-fold, respectively). This suggests that the helper lipid, PEG lipid, and ionizable lipid:phosphate ratio all contribute to the ApoE-dependence of different formulations made with the same ionizable lipids. (See Example 70 for LNP formulation procedure, e.g., for 10a-27 (5.7A), 10a-26 (5.7A), 10a-27 (4.5D), and 10a-26 (4.5D) LNPs.)

Example 62

Figure 59:
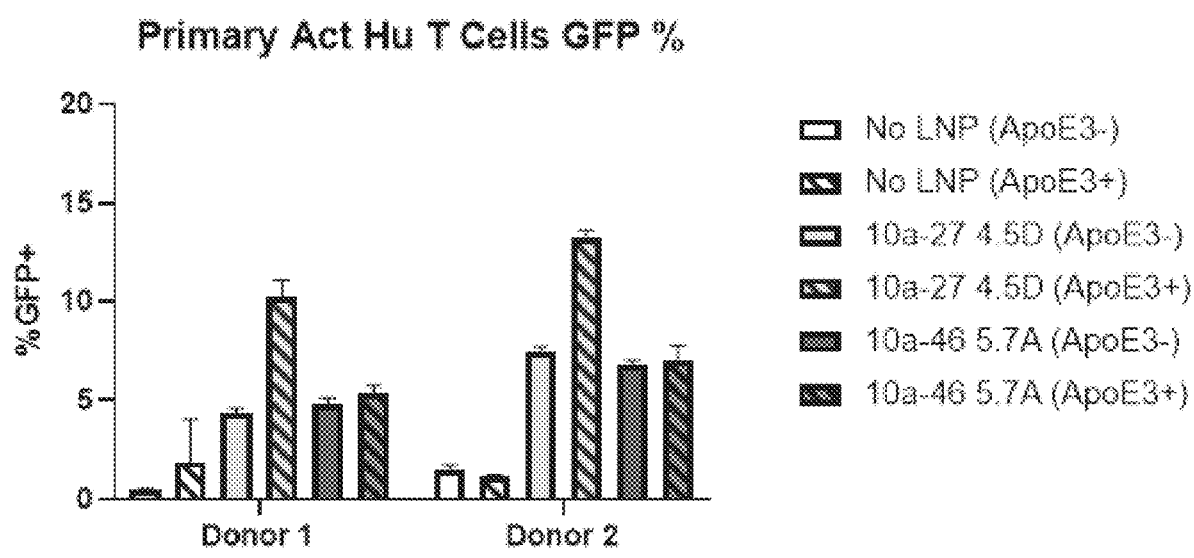
FIG. 59 shows uptake of LNP containing circular RNAs encoding eGFP into activated primary human T cells with or without the aid of ApoE3.

This example shows that different tail chemistries of LNPs result in different uptake mechanisms into T cells. To quantify the percent of human T cells expressing circRNA, LNPs containing eGFP circRNA were added to activated primary human T cells (prepared as described above in Example 61) at 200 ng RNA/well with or without ApoE3. After 24-hour incubation, cells were analyzed by flow cytometry and the percentage of live, GFP+ T cells was quantified. FIG. 59 graphs the % GFP+ T cells for 2 independent donors, with 5-10% of cells being GFP+ for LNP contatining Lipid 10a-27 (10a-27 (4.5D) LNP, see Example 70) and for LNP containing Lipid 10a-46 (10a-46 (5.7A) LNP, see Example 70). Although ApoE3 addition resulted in increased transfection for 10a-27 (4.5D) LNP, it did not appear to increase transfection for 10a-46 (5.7A) LNP, suggesting the different tail chemistries between Lipids 10a-27 and 10a-46 may mediate different uptake mechanisms into T cells.

Example 63

This example describes immune cell expression of Cre in a Cre reporter mouse model.

Ai9 mice (B6.Cg-Gt(ROSA)$_{26}$Sortm9(CAG-tdTomato) Hze/J, female, 6-8 weeks, n=3 per group) were injected i.v. with 0.5 mg/kg Cre circRNA LNPs or PBS. Ai9 mice transcribe and translate the fluorescent reporter tdTomato upon Cre recombination; meaning cells which are tdTomato+ have successfully been transfected with Cre circRNA. After 48 hours, mice were euthanized and their spleens were collected and manually processed into single cell suspensions. The splenocytes were stained for dead cells (LiveDead Fixable Aqua, Thermo) and with anti-mouse antibodies (TCR-B chain, BV421, H57-597; CD45, BV711, 30-F11; CD11b, BV785, ICRF44; NKp46, AF647, 29A1.4; CD19, APC/750, 6D5; TruStain FcX, 93; all antibodies from Biolegend) at 1:200 ratio. Flow cytometry was performed using an Attune Nxt Flow Cytometer (Thermo).

Figure 60:
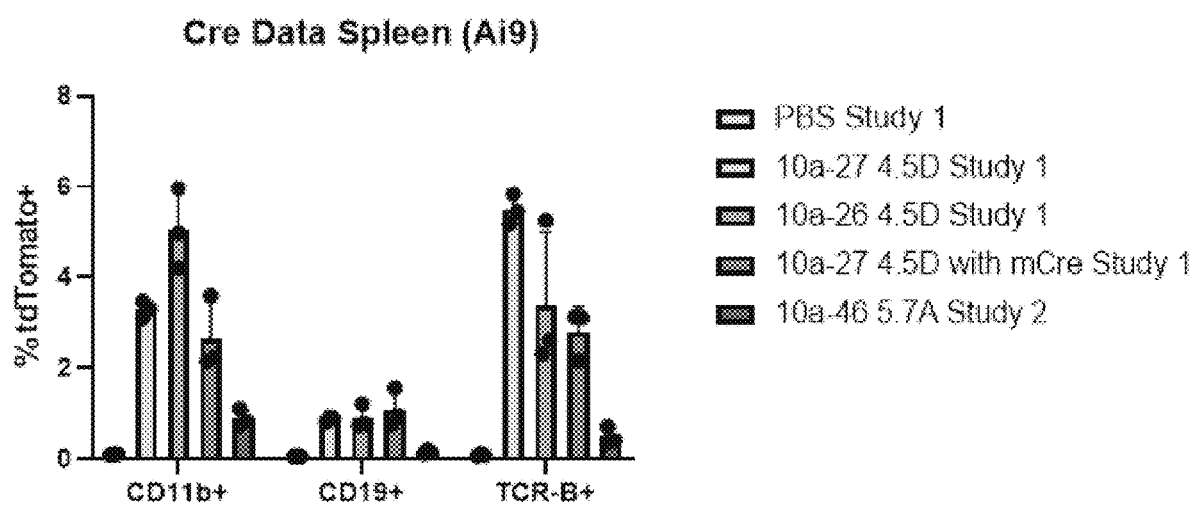
FIG. 60 shows immune cell expression from a LNP containing circular RNA encoding for a Cre fluorescent protein in a Cre reporter mouse model.

The percent of tdTomato+ cells in splenic myeloid cells (CD11b+), B cells (CD19+), and T cells (TCR-B+) is presented in FIG. 60. Lipid 10a-27 and Lipid 10a-46 differ only by their tail chemistries, and formulations made with Lipid 10a-27 transfect significantly more splenic immune cells than those made with Lipid 10a-46. Additionally, 10a-27 (4.5D) LNP (see Example 70) formulated with Cre circRNA transfected approximately twice as many T cells than those formulated with Cre linear mRNA, suggesting that circRNA may result in improved protein expression in splenic T cells compared to linear mRNA.

TABLE 23

Characterization of LNPs

| Formulation | Z-Average (nm) | PDI | RNA Encapsulation Efficiency (%) |
|---|---|---|---|
| 10a-27 (4.5D), Study 1 | 65 | 0.07 | 96 |
| 10a-26 (4.5D), Study 1 | 74 | 0.06 | 94 |
| 10a-27 (4.5D), with mCre, Study 1 | 75 | 0.05 | 93 |
| 10a-46 (5.7A), Study 2 | 86 | 0.01 | 94 |

Example 64

This example shows immune cell expression of mOX40L circRNA in wildtype mice.

C57BL/6 mice (female, 6-8 weeks, n=3 or 4 per group) were injected intravenously with 0.5 mg/kg mOX40L circRNA LNPs or PBS. After 24 hours, mice were euthanized and their spleens were collected and manually processed into single cell suspensions. Splenocytes were stained for dead cells (LiveDead Fixable Aqua, Thermo) and with anti-mouse antibodies (TCR-B chain, PacBlue, H57-597; CD11b, FITC, ICRF44; B220, PE, RA3-6B2; CD45, PerCP, 30-F11; mOX40L, AF647, RM134L; NK1.1, APC/750, PK136; TruStain FcX, 93; all antibodies from Biolegend) at 1:200. Flow cytometry was performed using an Attune NxT Flow Cytometer (Thermo).

Figure 61:
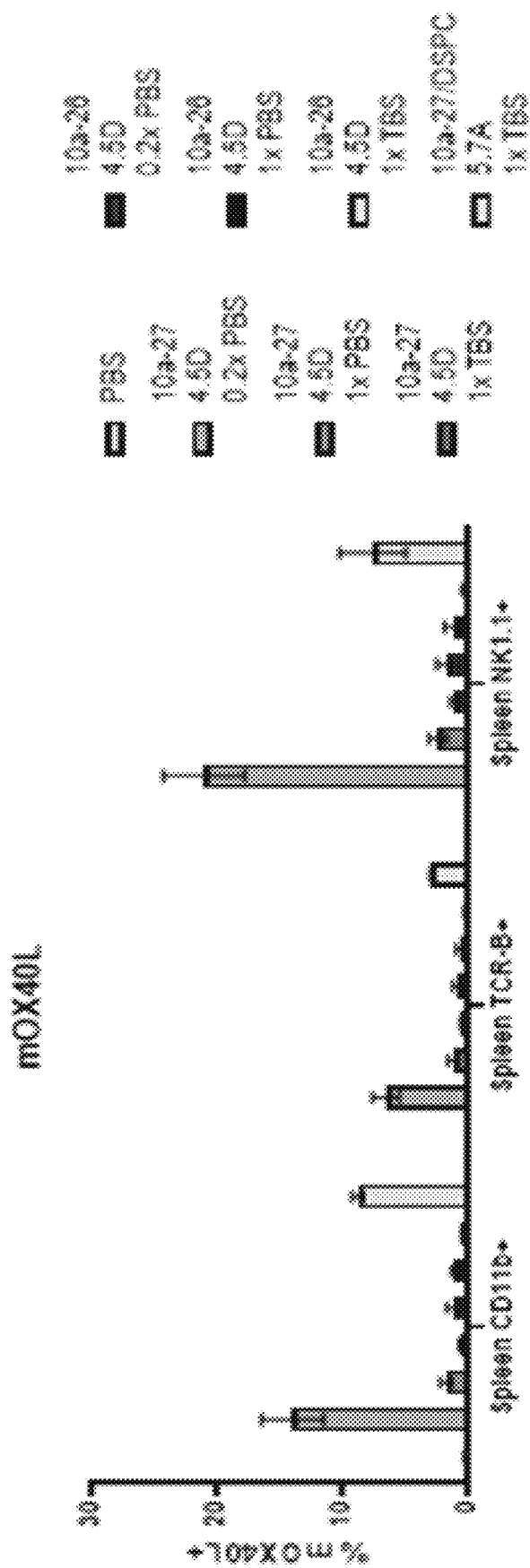
FIG. 61 shows immune cell expression of mOX40L in wildtype mice following intravenous injection of LNPs that have been transfected with circular RNAs encoding mOX40L.

The percent of mOX40L+ cells in splenic myeloid (CD11b+), T cells (TCR-B+), and NK cells (NK1.1+) is presented in FIG. 61. Notably, significantly different transfection efficiencies are observed between the same formulations injected intravenously in different buffers (hypotonic PBS, isotonic PBS, and isotonic TBS). 10a-27 4.5D LNP in hypotonic PBS results in approximately 14% myeloid cell transfection, 6% T cell transfection, and 21% NK cell transfection in the spleen. Of the formulations injected in isotonic buffer, 10a-27 DSPC 5.7A LNP demonstrates myeloid, T cell, and NK cell transfection in the spleen (9%, 3%, and 8%, respectively). (See Example 70 for LNP formulation procedure, e.g., for 10a-27 (4.5D) LNP and 10a-27 DSPC (5.7A) LNP.)

TABLE 24

Characterization of LNPs

| Formulation | Z-Average (nm) | PDI | RNA Encapsulation Efficiency (%) |
|---|---|---|---|
| 10a-27 (4.5D) | 63 | 0.02 | 93 |
| 10a-26 (4.5D) | 67 | 0.07 | 94 |
| 10a-27 DSPC (5.7A) | 82 | 0.05 | 96 |

Example 65

This example shows single dose escalation of mOX40L circRNA-LNPs in wildtype mice. [1118] 57BL/6 mice (female, 6-8 weeks, n=3 per group) were injected intravenously with 1 mg/kg or 3 mg/kg mOX40L circRNA LNPs or buffer control. After 24 hours, mice were euthanized and their spleens were collected and manually processed into single cell suspensions. Splenocytes were stained for dead cells (LiveDead Fixable Blue, Thermo) and stained with anti-mouse antibodies (TCR-B chain, BV421, H57-597; CD19, BV605, 6D5; CD45, BV711, 30-F11; CD11b, BV785, ICRF44; CD11c, FITC, N418; CD8a, PerCP, 53-6.7;

mOX40L, PE, RM134L; NKp46, AF647, 29A1.4; CD4, APC/750, GK1.5; TruStain FcX, 93; all antibodies from Biolegend) at 1:200. Flow cytometry was performed using a BD FACSSymphony flow cytometer.

Figure 62C:
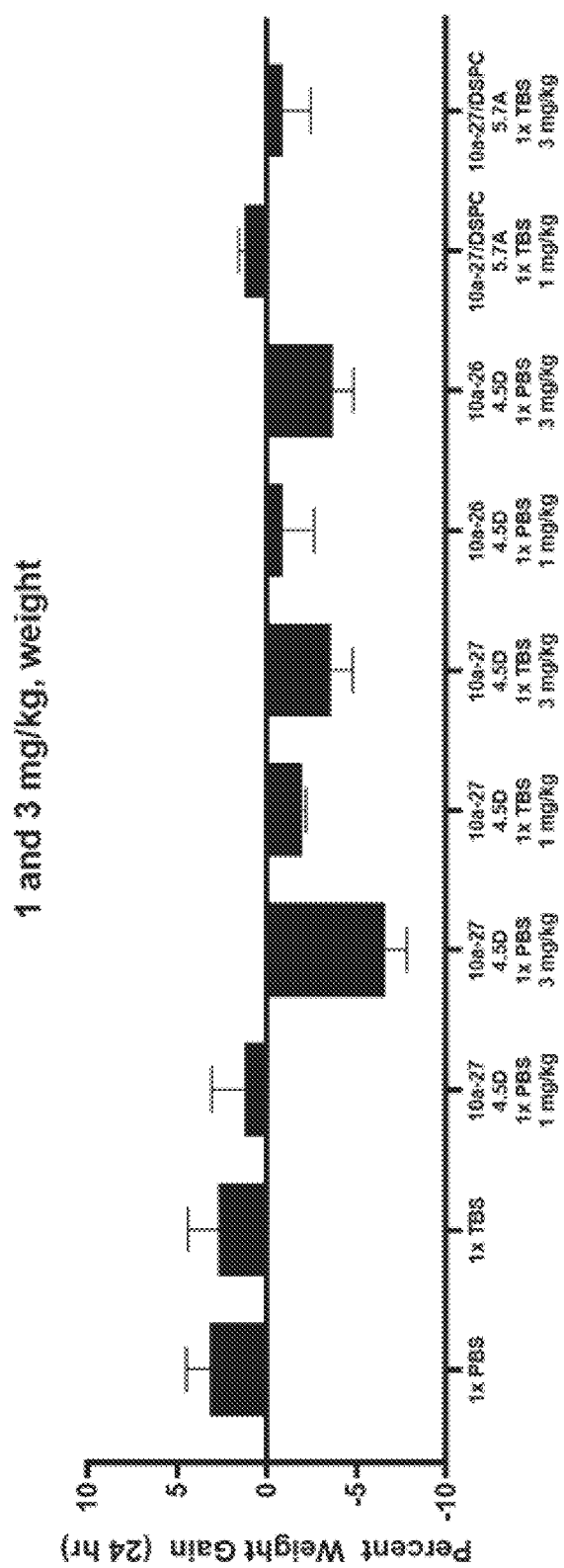

The percent of mOX40L+ cells in splenic T cells (all TCR-B+), CD4+ T cells (TCR-B+, CD4+), CD8+ T cells (TCR-B+, CD8a+), B cells (CD19+), NK cells (NKp46+), dendritic cells (CD11c+), and other myeloid cells (CD11b+, CD11c−) are shown in FIG. 62A and FIG. 62B, with corresponding mouse weight change after 24 hours shown in FIG. 62C. A dose-dependent increase in immune cell subset transfection is observed across 1 mg/kg and 3 mg/kg for all groups, with the exception of 10a-27 (4.5D) LNP 1×PBS group. At the 3 mg/kg dose, three different LNPs (10a-27 (4.5D) in TBS, 10a-26 (4.5D) in PBS, and 10a-27 DSPC (5.7A) in TBS; see Example 70 for formulation procedures) achieve 10-20% mOX40L transfection in splenic T cells, with similar transfection rates observed among CD4+ and CD8+ subsets. These three formulations also result in approximately 20% B cell, 60-70% dendritic cell, 60-70% NK cell, and 30-40% other myeloid cell mOX40L transfection in the spleen at 3 mg/kg. These three formulations lead to only minor (0-3%) mouse weight loss at 24 hours at the 3 mg/kg single dose with no reported clinical observations.

TABLE 25

Characterization of LNPs

| Formulation | Z-Average (nm) | PDI | RNA Encapsulation Efficiency (%) |
|---|---|---|---|
| 10a-27 (4.5D) | 76 | 0.06 | 91 |
| 10a-26 (4.5D) | 67 | 0.01 | 88 |
| 10a-27 DSPC (5.7A) | 77 | 0.01 | 93 |

Example 66

This example shows circRNA-LNP CAR-mediated B cell depletion in mice.

C57BL/6 mice (female, 6-8 weeks, n=5 per group) were injected intravenously with 0.5 mg/kg aCD19-CAR circRNA LNPs or control FLuc circRNA LNPs on Days 0, 2, 5, 7, and 9. On Days −1, 1, 8 and 12, submandibular bleeds were performed to collect blood. 30 µL of blood was lysed with ACK lysis buffer and washed with MACS buffer to isolate immune cells. On Day 12, mice were euthanized and their spleens were collected and manually processed into single cell suspensions. To assess the frequency of B cells in the blood and spleen, these single cell suspensions were stained for dead cells (LiveDead Fixable Aqua, Thermo) and stained with anti-mouse antibodies (TCR-B chain, PacBlue, H57-597; CD11b, FITC, ICRF44; B220, PE, RA3-6B2; CD45, PerCP, 30-F11; TruStain FcX, 93; all antibodies from Biolegend) at 1:200. Flow cytometry was performed using an Attune NxT Flow Cytometer (Thermo).

Figure 63A:
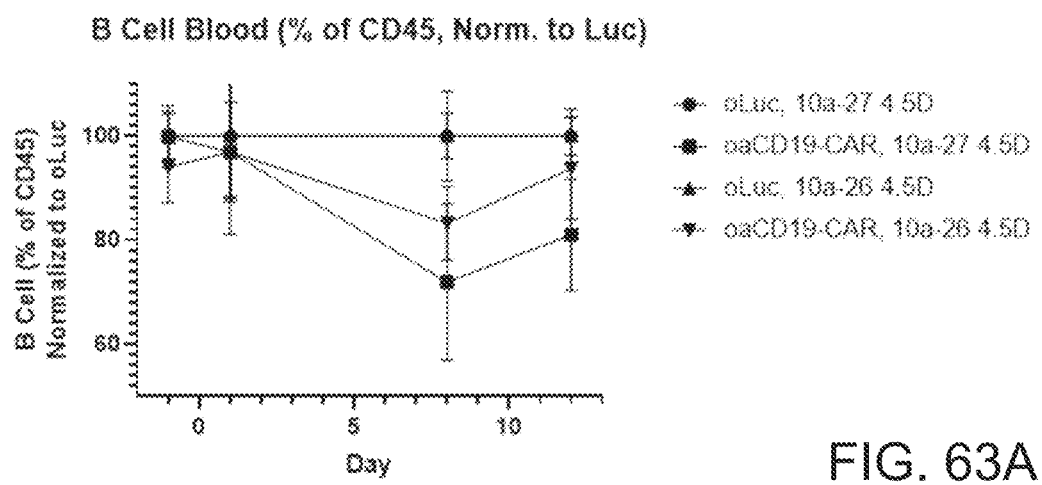
FIGS. 63A-63C show B cell depletion of LNPs transfected intravenously with circular RNAs in mice.
Figure 63B:
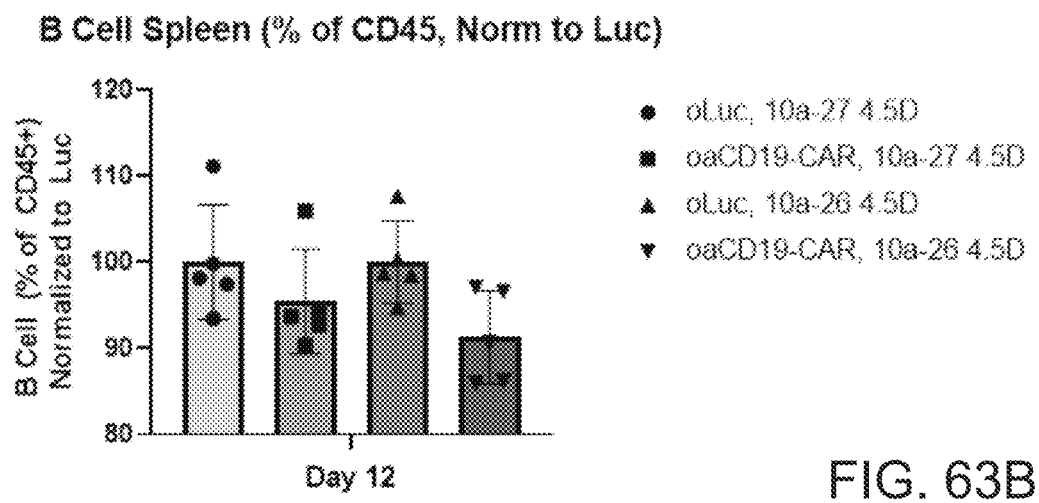

FIG. 63A quantifies the B cell depletion observed in this study, as defined by percentage of B220+ B cells of live, CD45+ immune cells. The B cell depletion in the aCD19-CAR circRNA LNP group was compared to its respective FLuc circRNA LNP control on Days 8 and 12 (for blood) and Day 12 (for spleen). In the blood, aCD19-CAR 10a-27 (4.5D) and 10a-26 (4.5D) LNPs resulted in approximately 28% and 17% reductions, respectively, in % B220+ of live CD45+ at Day 8 compared to FLuc control. In the spleen, aCD19-CAR 10a-27 (4.5D) and 10a-26 (4.5D) LNPs resulted in approximately 5% and 9% reductions in % B220+ of live CD45+ at Day 12 compared to FLuc control as shown in FIG. 63B. In all, these results suggest that CAR-mediated B cell depletion is occurring in mice treated with aCD19-CAR circRNA LNPs for Lipid 10a-27 (4.5D) and Lipid 10a-26 (4.5D).

Figure 63C:
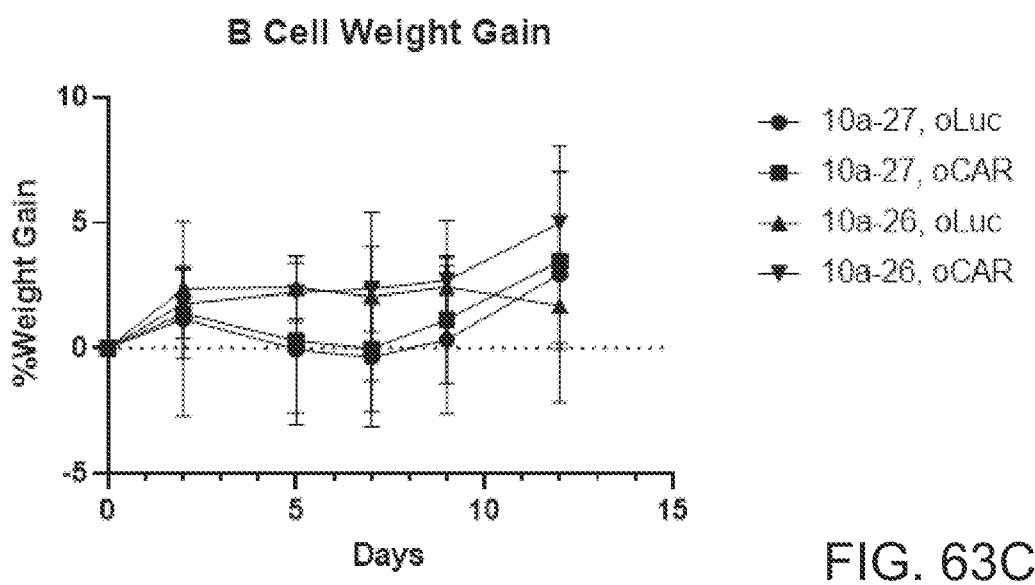

In addition, FIG. 63C shows the percent weight gain of mice in this study. There was not significant weight loss on average from the 10a-27 4.5D or 10a-26 4.5D LNP treated mice (5×0.5 mg/kg over 9 days), suggesting that these LNPs may be well-tolerated in mice at this dose and schedule.

TABLE 26

Characterization of LNPs

| Formulation | Z-Average (nm) | PDI | RNA Encapsulation Efficiency (%) |
|---|---|---|---|
| 10a-27 (4.5D), oLuc | 65 | 0.03 | 93 |
| 10a-27 (4.5D), oaCD19-CAR | 74 | 0.02 | 96 |
| 10a-26 (4.5D), oLuc | 71 | 0.04 | 91 |
| 10a-26, (4.5D), oaCD19-CAR | 71 | 0.04 | 93 |

Example 67

LNP and Circular RNA Construct Containing Anti-CD19 CAR Reduces B Cells in the Blood and Spleen In Vivo.

Circular RNA constructs encoding an anti-CD19 CAR expression were encapsulated within lipid nanoparticles as described above. For comparison, circular RNAs encoding luciferase expression were encapsulated within separate lipid nanoparticle.

Figure 64A:
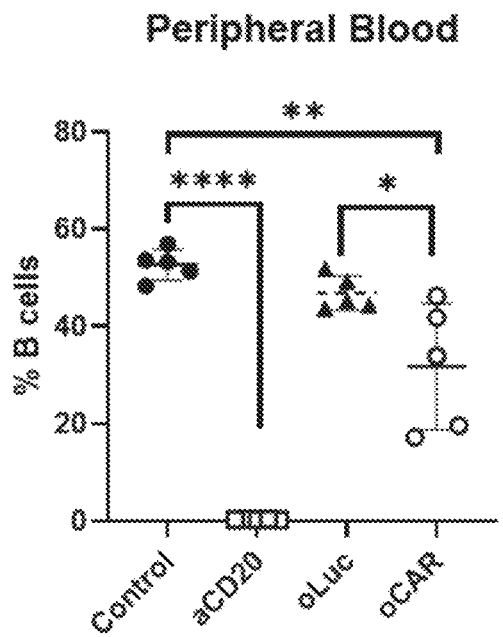
FIGS. 64A and 64B show CAR expression levels in the peripheral blood (FIG. 64A) and spleen (FIG. 64B) when treated with LNP encapsulating circular RNA that expresses anti-CD19 CAR. Anti-CD20 (aCD20) and circular RNA encoding luciferase (oLuc) were used for comparison.
Figure 64B:
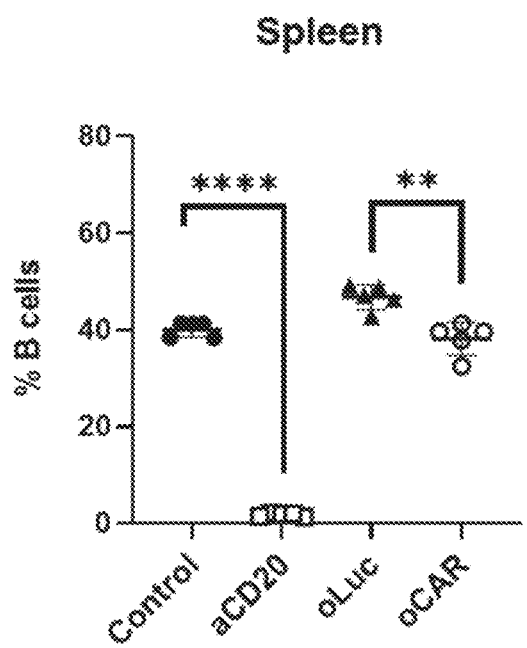
Figure 65A:
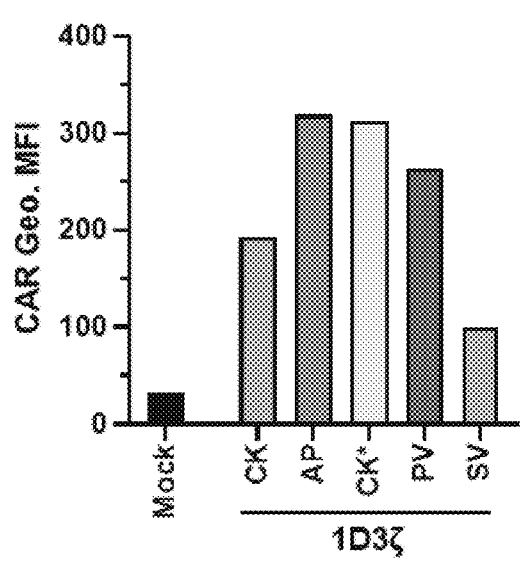
FIGS. 65A-65C show the overall frequency of anti-CD19 CAR expression, the frequency of anti-CD19 CAR expression on the surface of cells and effect on anti-tumor response of IRES specific circular RNA encoding anti-CD19 CARs on T-cells.
Figure 65B:
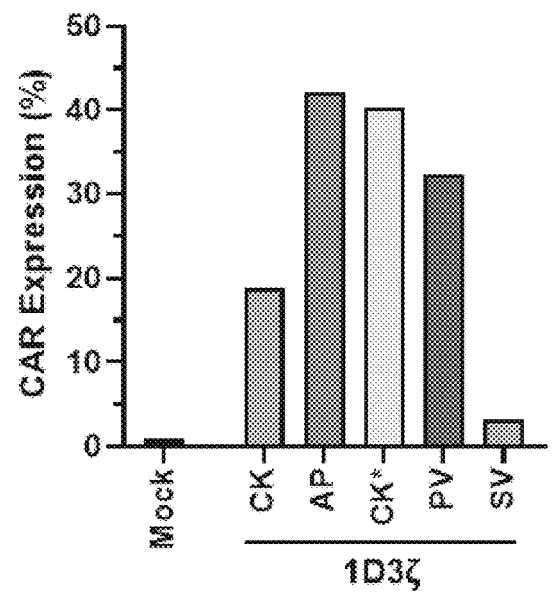
Figure 65C:
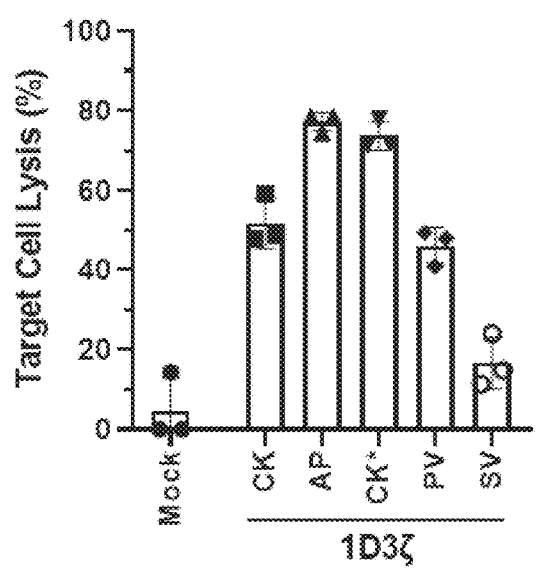
Figure 66:
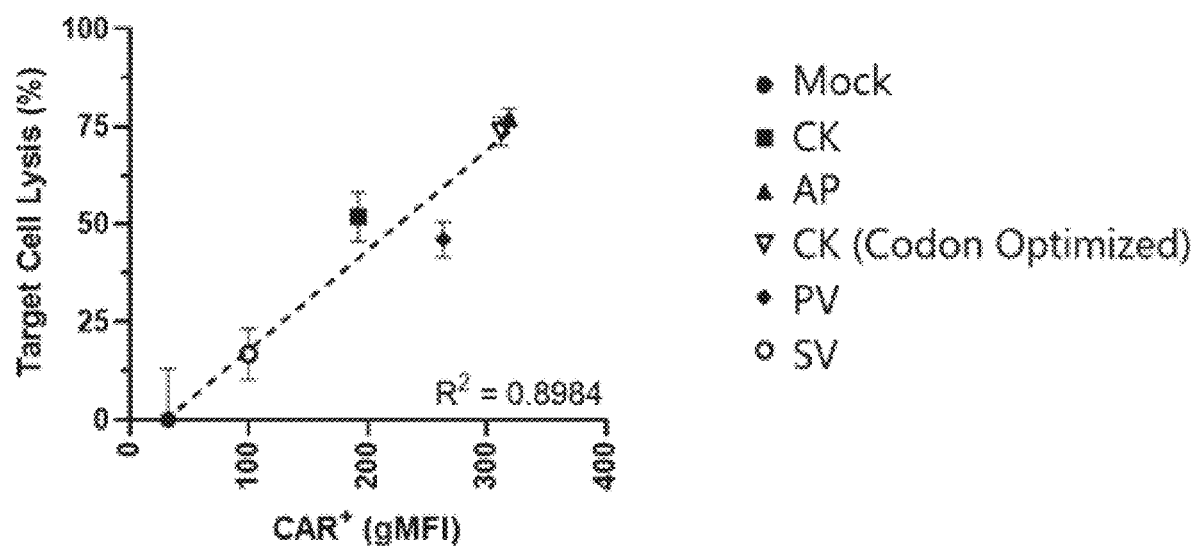
FIG. 66 shows CAR expression levels of A20 FLuc target cells when treated with IRES specific circular RNA constructs.

C57BL/6 mice at 6 to 8 weeks old were injected with either LNP solution every other day for a total of 4 LNP injections within each mouse. 24 hours after the last LNP injection, the mice's spleen and blood were harvested, stained, and analyzed via flow cytometry. As shown in FIG. 64A and FIG. 64B, mice containing LNP-circular RNA constructs encoding an anti-CD19 CAR led to a statistically significant reduction in CD19+ B cells in the peripheral blood and spleen compared to mice treated with LNP-circular RNA encoding a luciferase.

Example 68

IRES Sequences Contained within Circular RNA Encoding CARs Improves CAR Expressions and Cytotoxicity of T-Cells.

Activated murine T-cells were electroporated with 200 ng of circular RNA constructs containing a unique IRES and a murine anti-CD19 1D3(CAR expression sequence. The IRES contained in these constructs were derived either in whole or in part from a Caprine Kobuvirus, Apodemus Picornavirus, Parabovirus, or Salivirus. A Caprine Kobuvirus derived IRES was additionally codon optimized. As a control, a circular RNA containing a wild-type zeta mouse CAR with no IRES was used for comparison. The T-cells were stained for the CD-19 CAR 24 hours post electroporation to evaluate for surface expression and then co-cultured with A20 Fluc target cells. The assay was then evaluated for cytotoxic killing of the Fluc+A20 cells 24 hours after co-culture of the T-cells with the target cells.

As seen in FIGS. 65A, 65B, 65C, and 66, the unique IRES were able to increase the frequency that the T-cells expressed the CAR protein and level of CAR expression on the surface of the cells. The increase frequency of expression of the CAR protein and level of CAR expression on the surface of cells lead to an improved anti-tumor response.

Example 69

Cytosolic and Surface Proteins Expressed from Circular RNA Construct in Primary Human T-Cells.

Circular RNA construct contained either a sequence encoding for a fluorescent cytosolic reporter or a surface antigen reporter. Fluorescent reporters included green fluorescent protein, mCitrine, mWasabi, Tsapphire. Surface reporters included CD52 and Thy1.1$^{bio}$. Primary human T-cells were activated with an anti-CD3/anti-CD28 antibody and electroporated 6 days post activation of the circular RNA containing a reporter sequence. T-cells were harvested and analyzed via flow cytometry 24 hours post electroporation. Surface antigens were stained with commercially available antibodies (e.g., Biolegend, Miltenyi, and BD).

Figure 67A:
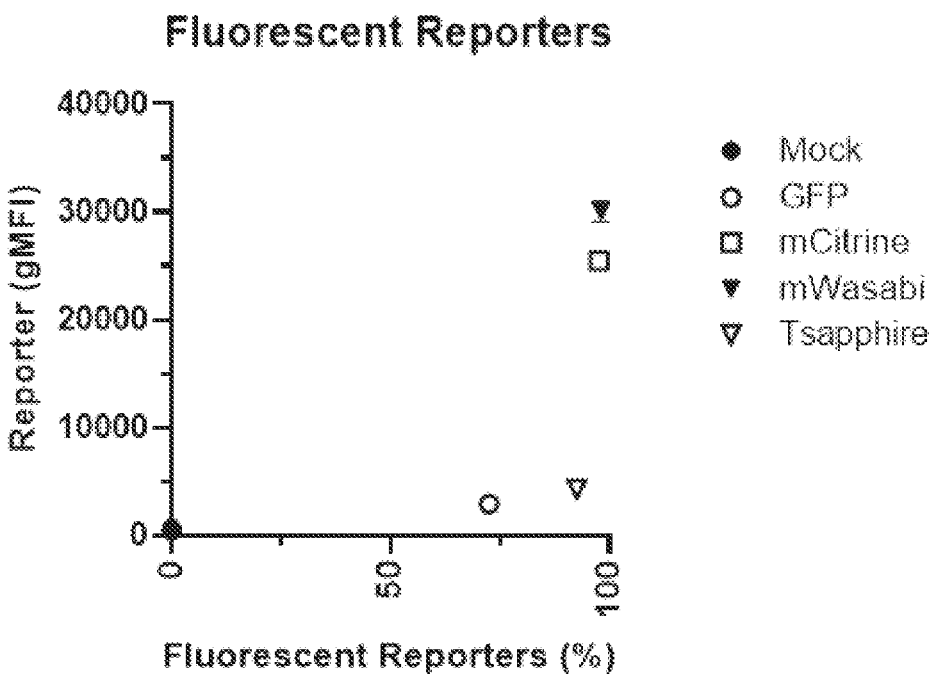
FIGS. 67A and 67B show luminescence expression levels for cytosolic (FIG. 67A) and surface (FIG. 67B) proteins from circular RNA in primary human T-cells.
Figure 67B:
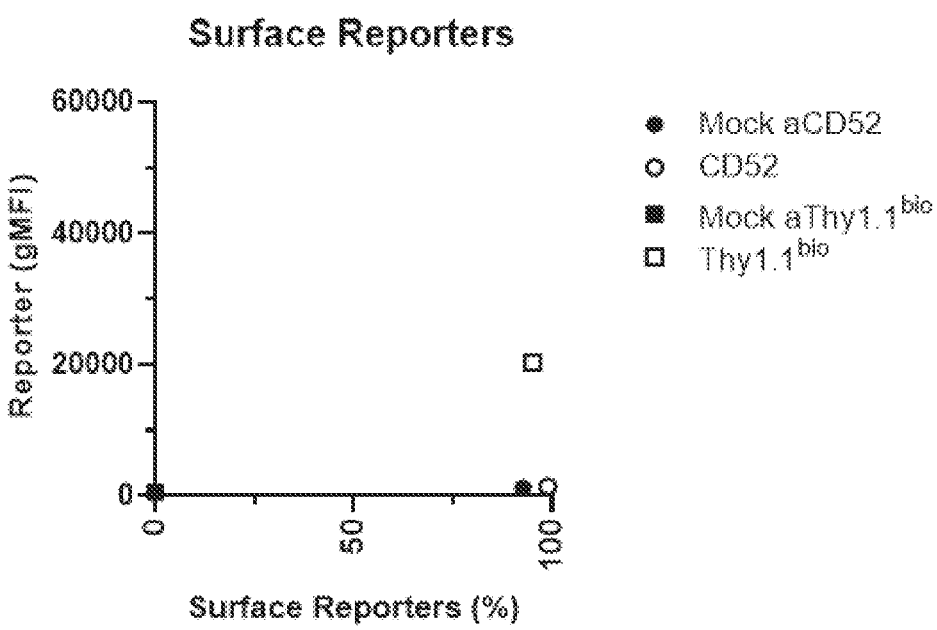
Figure 68A:
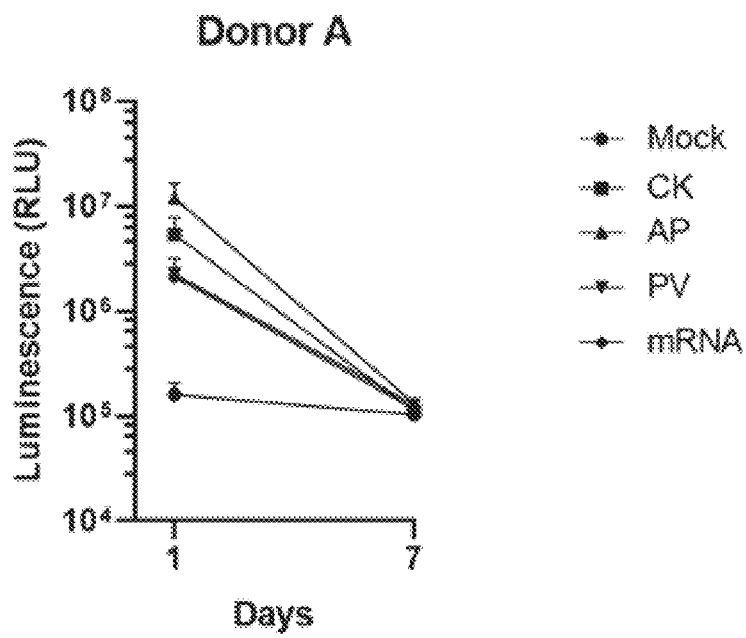
FIGS. 68A-68F show luminescence expression in human T-cells when treated with IRES specific circular constructs. Expression in circular RNA constructs were compared to linear mRNA.
Figure 68B:
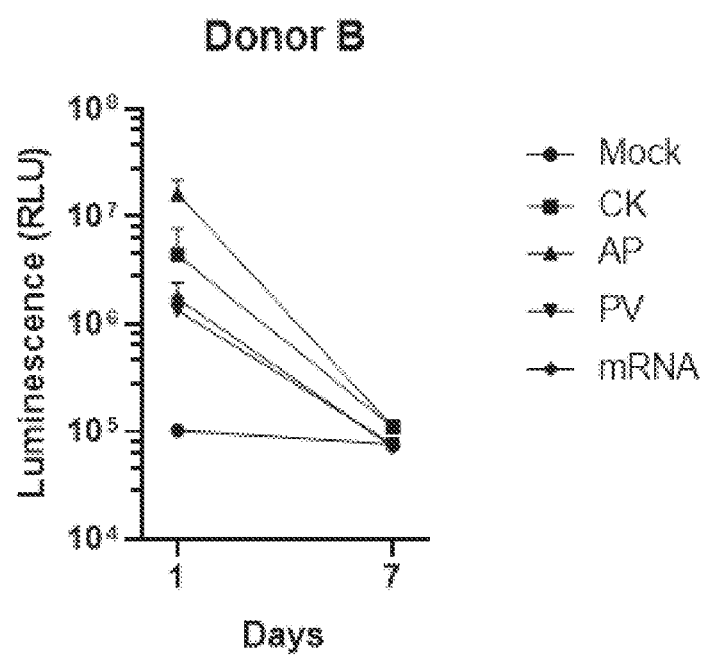
Figure 68C:
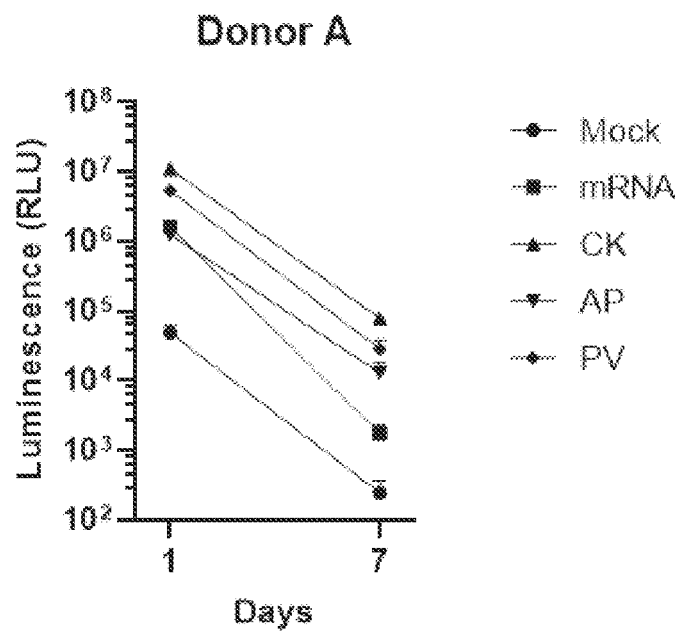
Figure 68D:
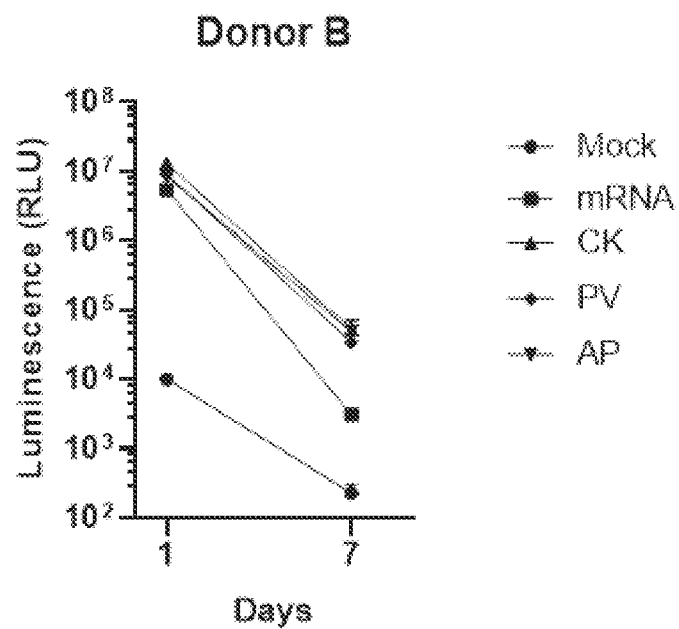
Figure 68E:
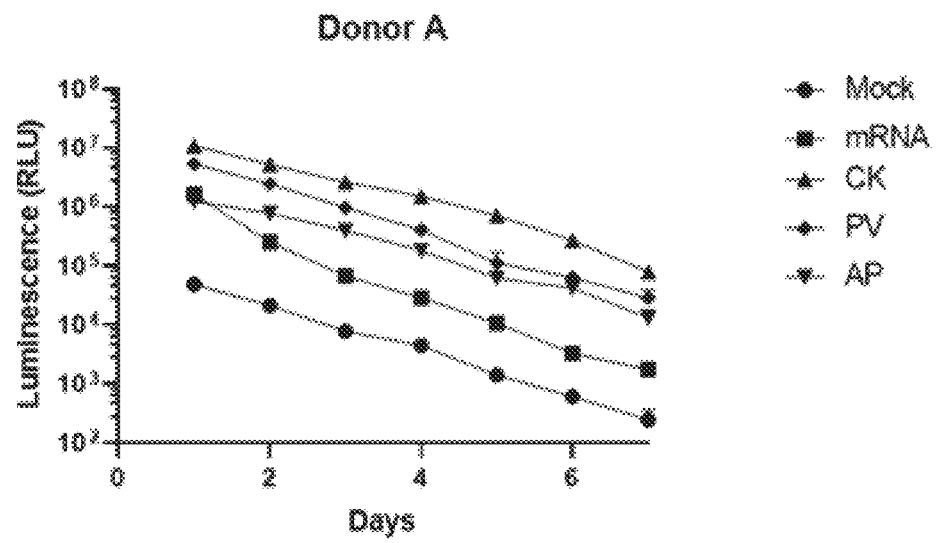
Figure 68F:
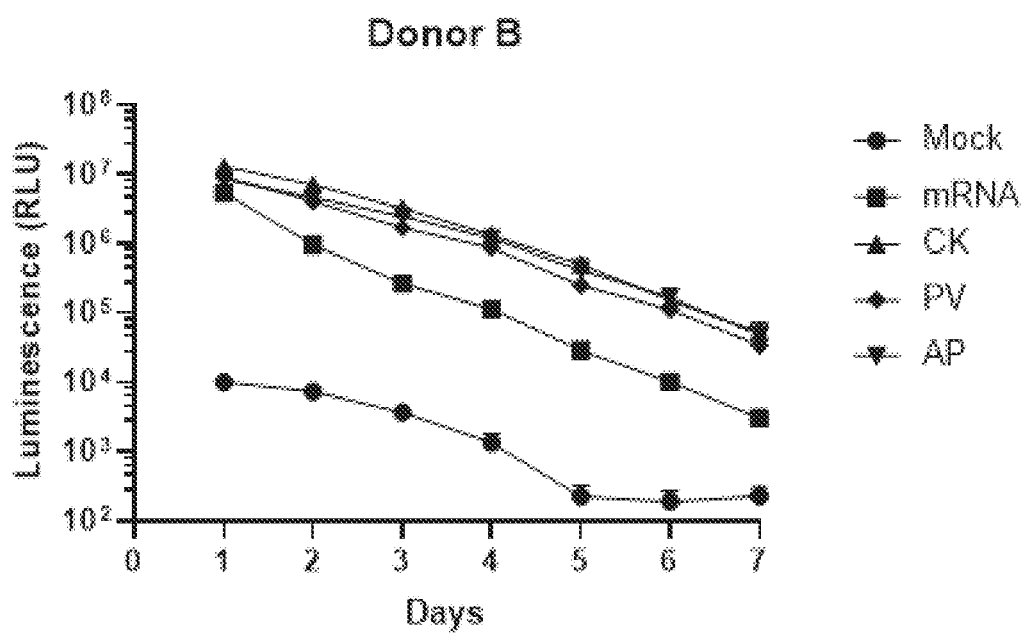
Figure 68G:
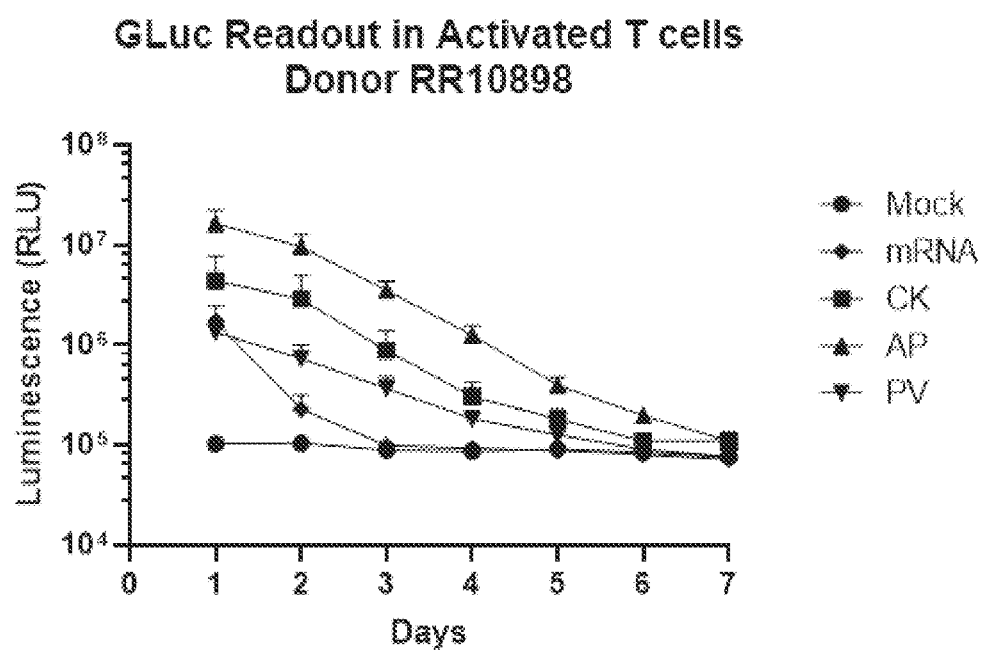

As seen in FIG. 67A and FIG. 67B, cytosolic and surface proteins can be expressed from circular RNA encoding the proteins in primary human T-cells.

Example 70

Circular RNAs Containing Unique IRES Sequences have Improved Translation Expression Over Linear mRNA.

Circular RNA constructs contained a unique IRES along with an expression sequence for Firefly luciferase (FLuc).

Human T-cells from 2 donors were enriched and stimulated with anti-CD3/anti-CD28 antibodies. After several days of proliferation, activated T cells were harvested and electroporated with equal molar of either mRNA or circular RNA expressing FLuc payloads. Various IRES sequences, including those derived from Caprine Kobuvirus, Apodemus Picornavirus, and Parabovirus, were studied to evaluate expression level and durability of the payload expression across 7 days. Across the 7 days, the T-cells were lysed with Promega Brightglo to evaluate for bioluminsences.

As shown in FIGS. 68C, 68D, 68E, 68F, and 68G, the presence of an IRES within a circular RNA can increase translation and expression of a cytosolic protein by orders of magnitude and can improve expression compared to linear mRNA. This was found consistent across multiple human T-cell donors.

Example 71

Example 71A: LNP-Circular RNA Encoding Anti-CD19 Mediates Human T-Cell Killing of K562 Cells Circular RNA constructs contained a sequence encoding for anti-CD19 antibodies. Circular RNA constructs were then encapsulated within a lipid nanoparticle (LNP).

Human T-cells were stimulated with anti-CD3/anti-CD28 and left to proliferate up to 6 says. At day 6, LNP-circular RNA and ApoE3 (1 µg/mL) were co-cultured with the T-cells to mediate transfection. 24 hours later, Fluc+K562 cells were electroporated with 200 ng of circular RNA encoding anti-CD19 antibodies and were later co-cultured at day 7. 48 hours post co-culture, the assay was assessed for CAR expression and cytotoxic killing of K562 cells through Fluc expression.

Figure 69A:
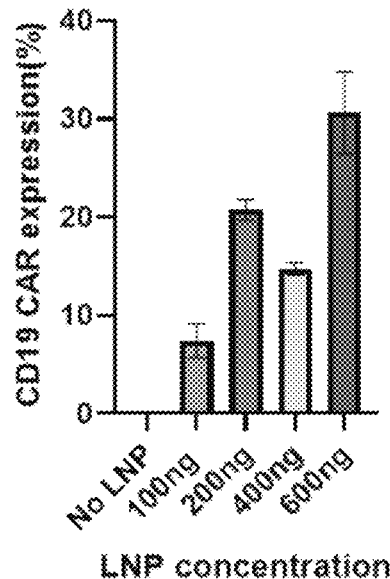
FIGS. 69A and 69B show anti-CD19 CAR (FIG. 69A and FIG. 69B) and anti-BCMA CAR (FIG. 69B) expression in human T-cells following treatment of a lipid nanoparticle encompassing a circular RNA that encodes either an anti-CD19 or anti-BCMA CAR to a firefly luciferase expressing K562 cell.
Figure 69B:
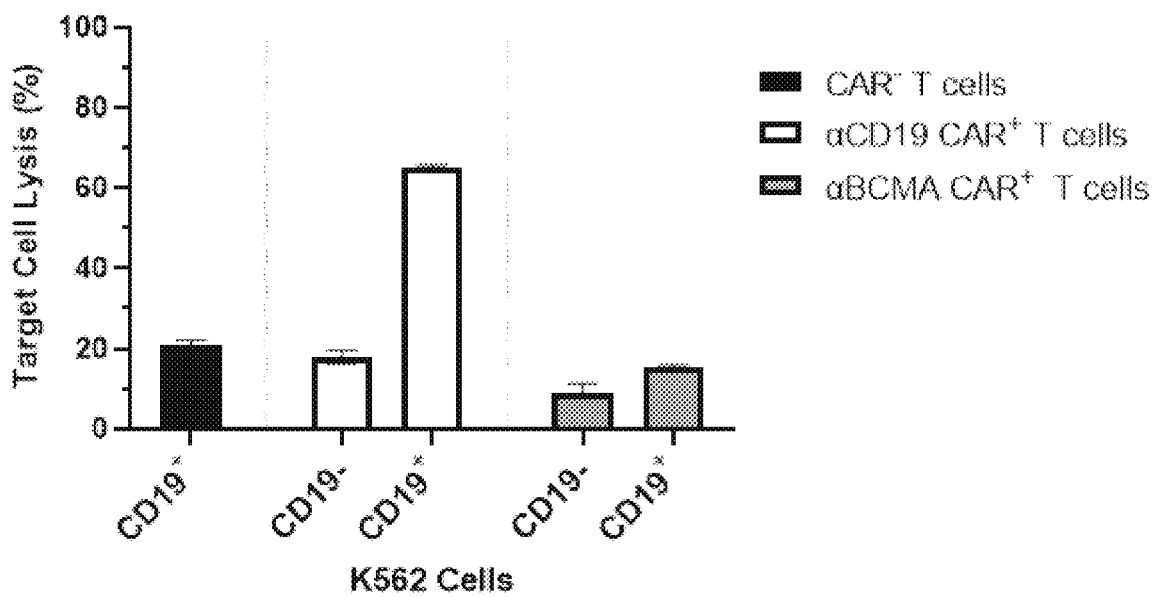

As shown in FIG. 69A and FIG. 69B, there is T-cell expression of anti-CD19 CAR from the LNP-mediated delivery of a CAR in vitro to T-cells and its capability to lyse tumor cells in a specific, antigen dependent manner in engineered K562 cells.

Example 71B: LNP-Circular RNA Encoding Anti-BCMA Antibody Mediates Human T-Cell Killing of K562 Cells Circular RNA constructs contained a sequence encoding for anti-BCMA antibodies. Circular RNA constructs were then encapsulated within a lipid nanoparticle (LNP).

Human T-cells were stimulated with anti-CD3/anti-CD28 and left to proliferate up to 6 says. At day 6, LNP-circular RNA and ApoE3 (1 µg/mL) were co-cultured with the T-cells to mediate transfection. 24 hours later, Fluc+K562 cells were electroporated with 200 ng of circular RNA encoding anti-BCMA antibodies and were later co-cultured at day 7. 48 hours post co-culture, the assay was assessed for CAR expression and cytotoxic killing of K562 cells through Fluc expression.

As shown in FIG. 69B, there is T-cell expression of BCMA CAR from the LNP-mediated delivery of a CAR in vitro to T-cells and its capability to lyse tumor cells in a specific, antigen dependent manner in engineered K562 cells.

Example 72

Anti-CD19 CAR T-Cells Exhibit Anti-Tumor Activity In Vitro.

Human T-cells were activated with anti-CD3/anti-CD28 and electroporated once with 200 ng of anti-CD19 CAR-expressing circular RNA. Electroporated T-cells were co-cultured with FLuc+ Nalm6 target cells and non-target Fluc+K562 cells to evaluate CAR-mediated killing. After 24 hours post co-culture, the T-cells were lysed and examined for remanent FLuc expression by target and non-target cells to evaluate expression and stability of expression across 8 days total.

Figure 70A:
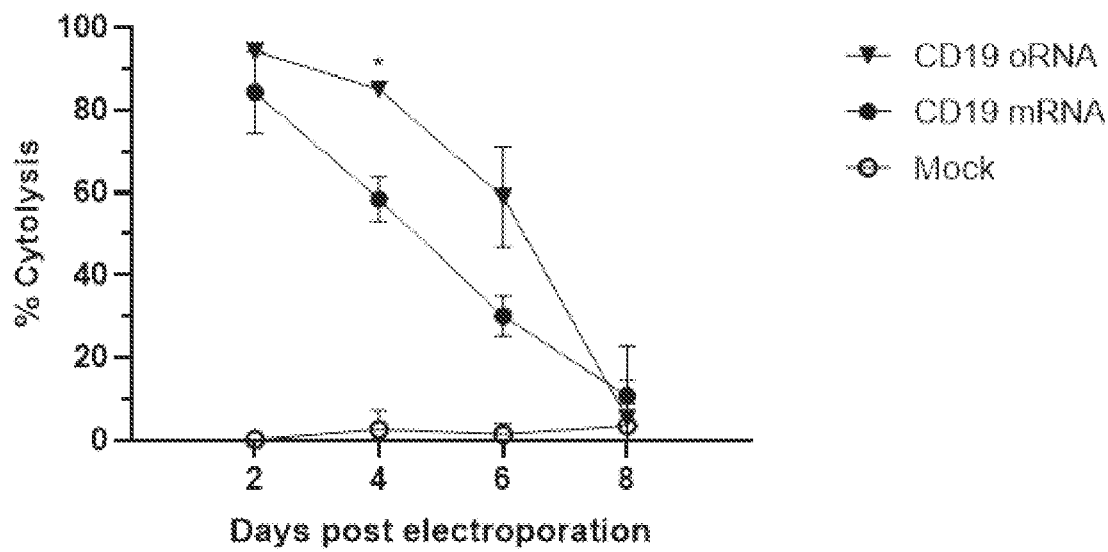
FIGS. 70A and 70B show anti-CD19 CAR expression levels resulting from delivery via electroporation in vitro of a circular RNA encoding an anti-CD19 CAR in a specific antigen-dependent manner.
Figure 70B:
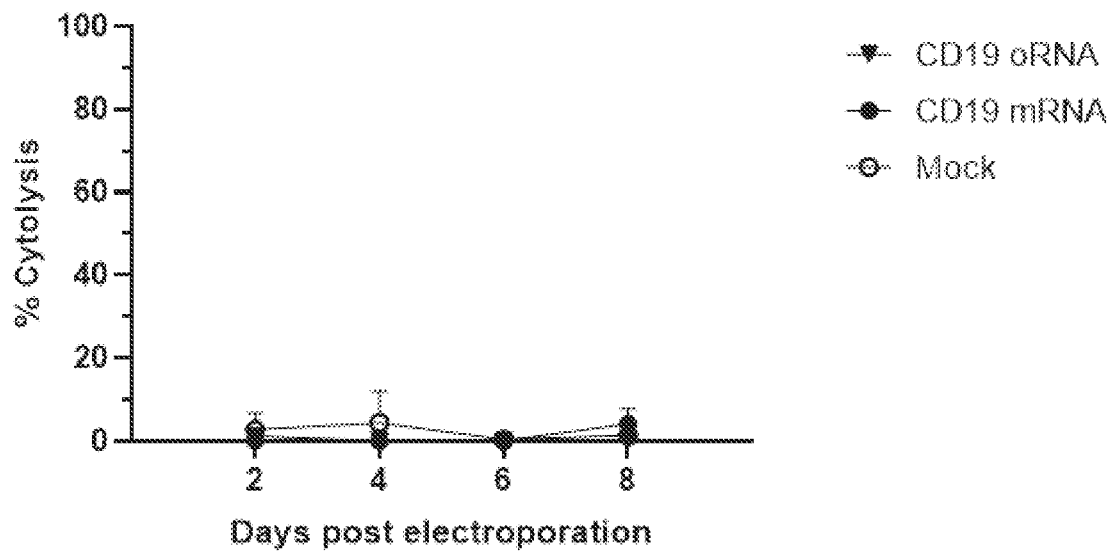
Figure 71A:
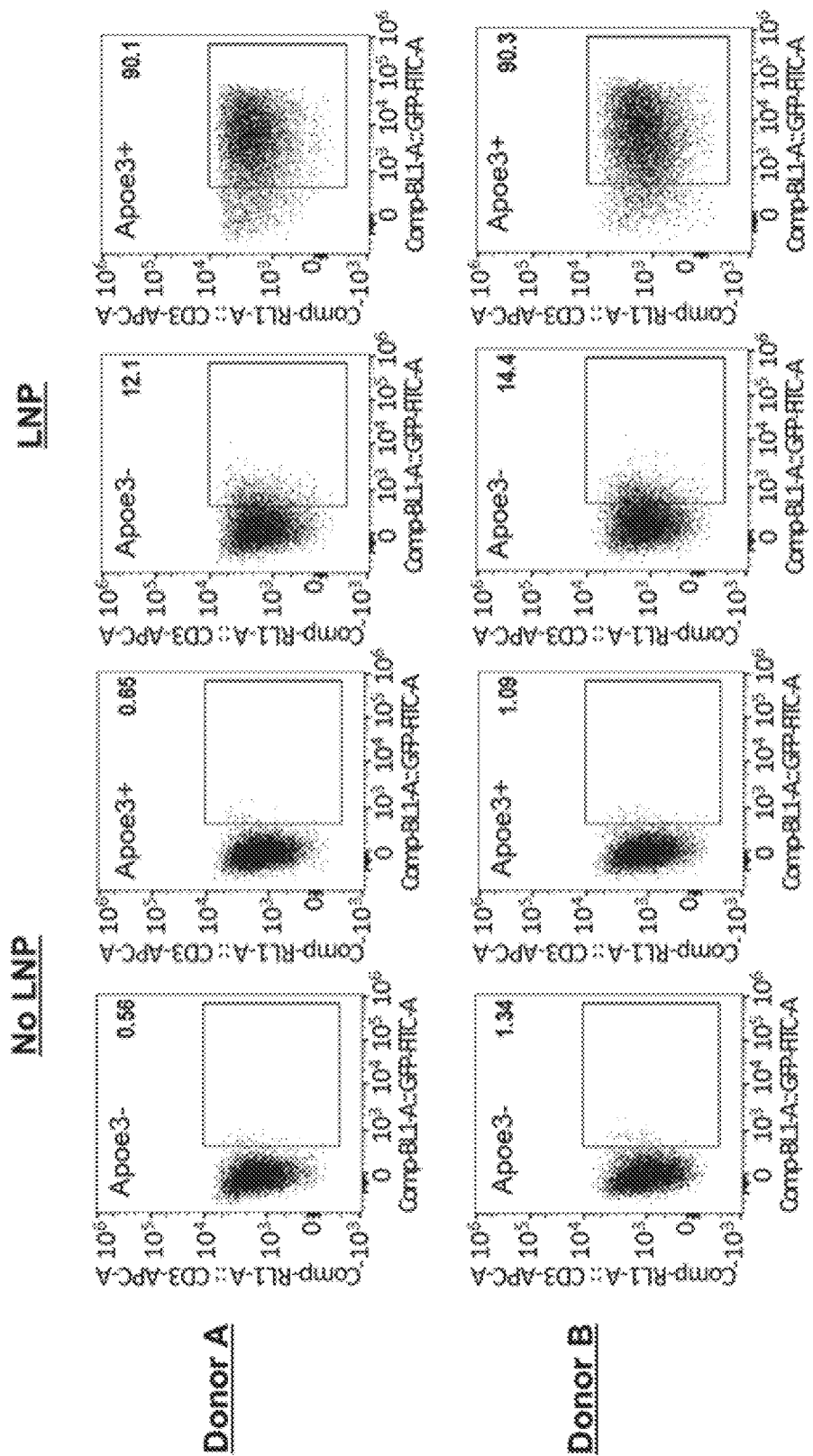
FIGS. 71A-71E show transfection of LNP mediated by use of ApoE3 in solutions containing LNP and circular RNA expressing green fluorescence protein (GFP).
Figure 71B:
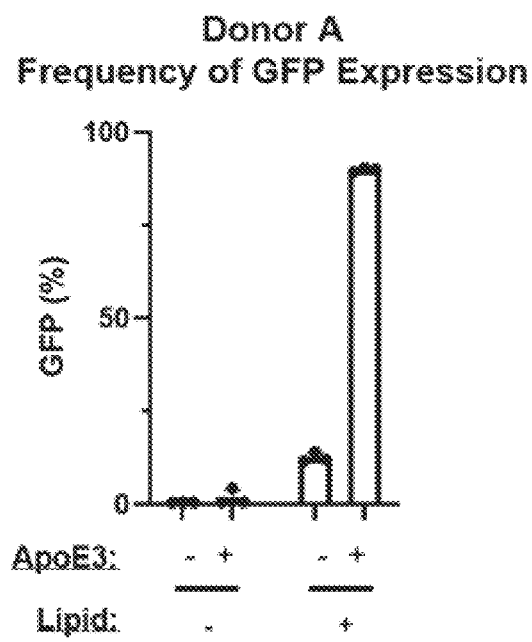
Figure 71C:
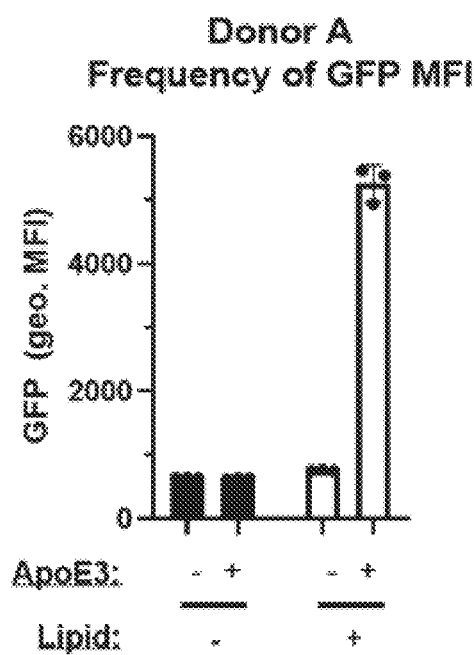
Figure 71D:
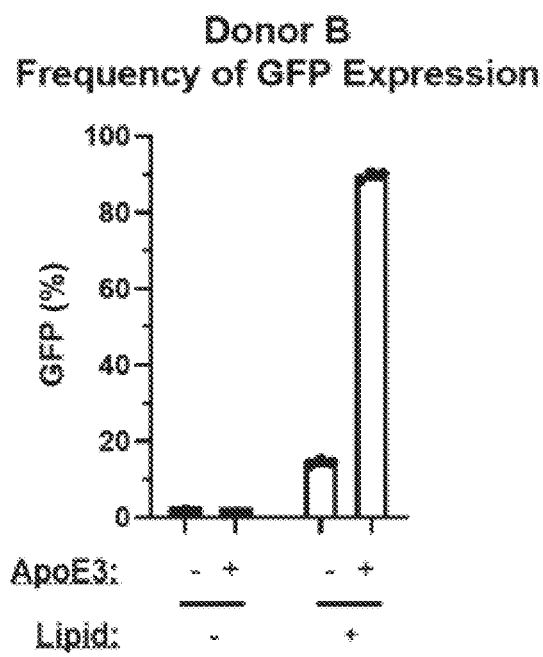
Figure 71E:
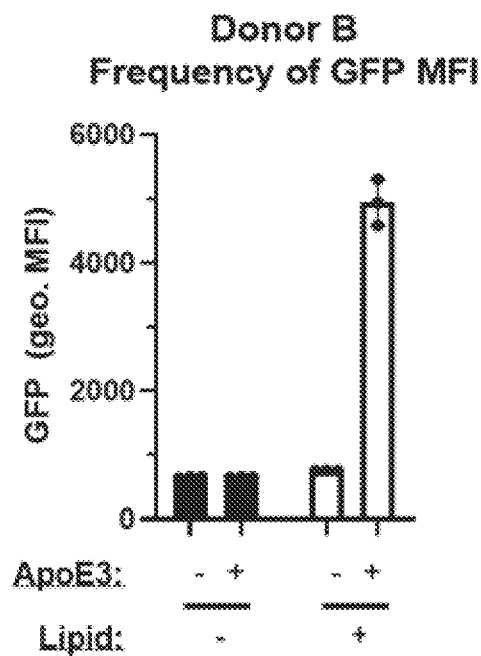

As shown in FIGS. 70A and 70B, T-cells express circular RNA CAR constructs in specific, antigen-dependent manner. Results also shows improved cytotoxicity of circular RNAs encoding CARs compared to linear mRNA encoding CARs and delivery of a functional surface receptor.

Example 73

Effective LNP Transfection of Circular RNA Mediated with ApoE3

Human T-cells were stimulated with anti-CD3/anti-CD28 and left to proliferate up to 6 days. At day 6, lipid nanoparticle (LNP) was and circular RNA expressing green fluorescence protein solution with or without ApoE3 (1 µg/mL) were co-cultured with the T-cells. 24 hours later, the T-cells were stained for live/dead T-cells and the live T-cells were analyzed for GFP expression on a flow cytometer.

As shown by FIGS. 71A, 71B, 71C, 72D, and 71E, efficient LNP transfection can be mediated by ApoE3 on activated T-cells, followed by significant payload expression. These results were exhibited across multiple donors.

Example 74

Example 74A: Lipid Nanoparticle Formulation Procedure

A Zetasizer Nano ZS (Malvern Instruments Ltd, Malvern, Worcestershire, UK) can be used to determine the particle size, the polydispersity index (PDI) and the zeta potential of the transfer vehicle compositions in 1×PBS in determining particle size and 15 mM PBS in determining zeta potential.

Ultraviolet-visible spectroscopy can be used to determine the concentration of a therapeutic and/or prophylactic (e.g., RNA) in transfer vehicle compositions. 100 μL of the diluted formulation in 1×PBS is added to 900 μL of a 4:1 (v/v) mixture of methanol and chloroform. After mixing, the absorbance spectrum of the solution is recorded, for example, between 230 nm and 330 nm on a DU 800 spectrophotometer (Beckman Coulter, Beckman Coulter, Inc., Brea, CA). The concentration of therapeutic and/or prophylactic in the transfer vehicle composition can be calculated based on the extinction coefficient of the therapeutic and/or prophylactic used in the composition and on the difference between the absorbance at a wavelength of, for example, 260 nm and the baseline value at a wavelength of, for example, 330 nm.

For transfer vehicle compositions including RNA, a QUANT-IT™ RIBOGREEN® RNA assay (Invitrogen Corporation Carlsbad, CA) can be used to evaluate the encapsulation of RNA by the transfer vehicle composition. The samples are diluted to a concentration of approximately 5 μg/mL or 1 μg/mL in a TE buffer solution (10 mM Tris-HCl, 1 mM EDTA, pH 7.5). 50 μL of the diluted samples are transferred to a polystyrene 96 well plate and either 50 μL of TE buffer or 50 μL of a 2-4% Triton X-100 solution is added to the wells. The plate is incubated at a temperature of 37° C. for 15 minutes. The RIBOGREEN® reagent is diluted 1:100 or 1:200 in TE buffer, and 100 μL of this solution is added to each well. The fluorescence intensity can be measured using a fluorescence plate reader (Wallac Victor 1420 Multilablel Counter; Perkin Elmer, Waltham, MA) at an excitation wavelength of, for example, about 480 nm and an emission wavelength of, for example, about 520 nm. The fluorescence values of the reagent blank are subtracted from that of each of the samples and the percentage of free RNA is determined by dividing the fluorescence intensity of the intact sample (without addition of Triton X-100) by the fluorescence value of the disrupted sample (caused by the addition of Triton X-100).

Example 74B: RNA Encapsulation, Total Flux, and Percent Expression In Vitro for Ionizable Lipid:DOPE:Cholesterol:DSPE-PEG(2000) Formulation Ratio of 62:4:33:1

Figure 72A:
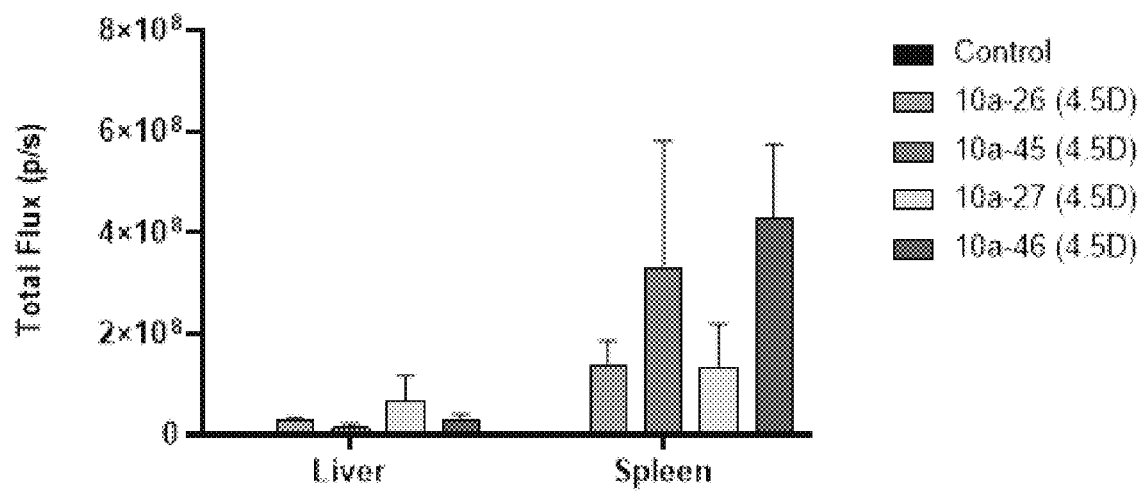
FIG. 72A, FIG. 72B, FIG. 72C, FIG. 72D, FIG. 72E, FIG. 72F, FIG. 72G, FIG. 72H, FIG. 72I, FIG. 72J, FIG. 72K, and FIG. 72L show total flux and percent expression for varying lipid formulations. See Example 74.
Figure 72B:
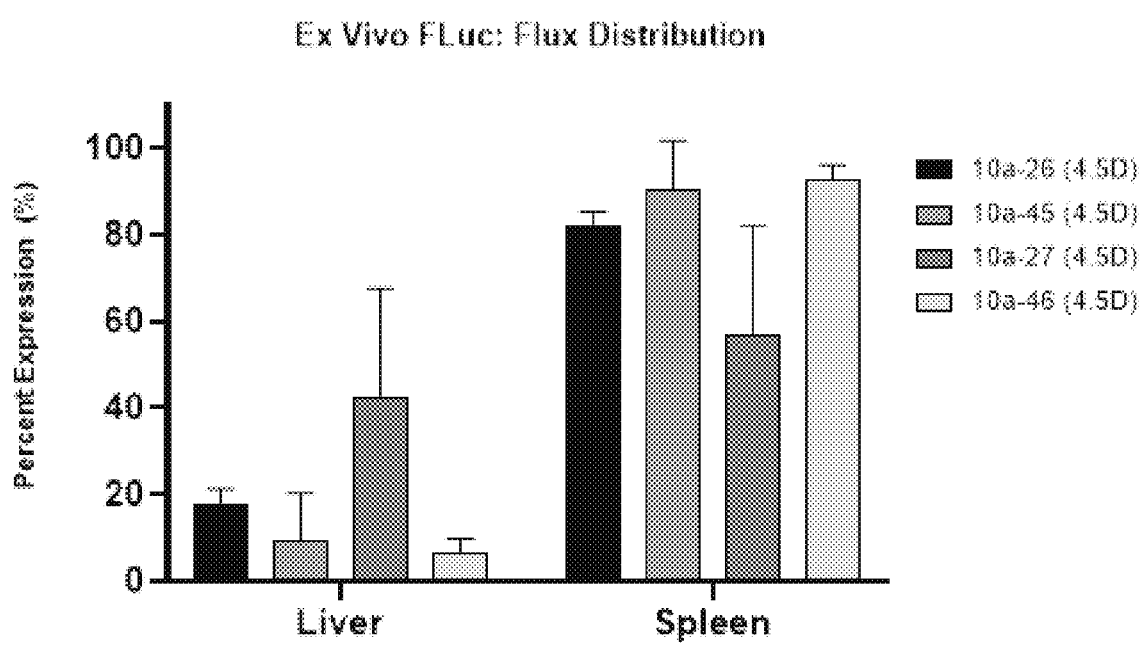

Lipid nanoparticles were formulated using Lipid 10a-27, 10a-26, 10a-46, or 10a-45 in a ionizable lipid:DOPE:cholesterol:DSPE-PEG(2000) formulation ratio of 62:4:33:1 mol, and encapsulate the RNA molecule at a lipid-nitrogen-to-phosphate ratio (N:P) of 4.5. Expression of the RNA was present in all formulations. There was a greater total flux and percent expression within the spleen as shown in FIGS. 72A and 72B respectively.

| Formulation | Ionizable lipid | Helper lipid | PEG-lipid | Ionizable lipid:Helper lipid:Cholesterol:PEG-lipid (mol %) | Z-Average (nm) | PDI | RNA Encapsulation Efficiency (%) |
|---|---|---|---|---|---|---|---|
| 10a-27 (4.5D) | Lipid 10a-27 | DOPE | DSPE-PEG(2000) | 62:4:33:1 | 71 | 0.02 | 94 |
| 10a-26 (4.5D) | Lipid 10a-26 | DOPE | DSPE-PEG(2000) | 62:4:33:1 | 71 | 0.04 | 92 |
| 10a-46 (4.5D) | Lipid 10a-26 | DOPE | DSPE-PEG(2000) | 62:4:33:1 | 110 | 0.1 | 93 |
| 10a-45 (4.5D) | Lipid 10a-25 | DOPE | DSPE-PEG(2000) | 62:4:33:1 | 157 | 0.13 | 83 |

Example 74C: RNTA Encapsulation, Total Flux, and Percent Expression In Vitro for Ionizable Lipid:DOPE:Cholesterol:DMG-PEG(2000) Formulation Ratio of 50:10:38.5:1.5

Figure 72C:
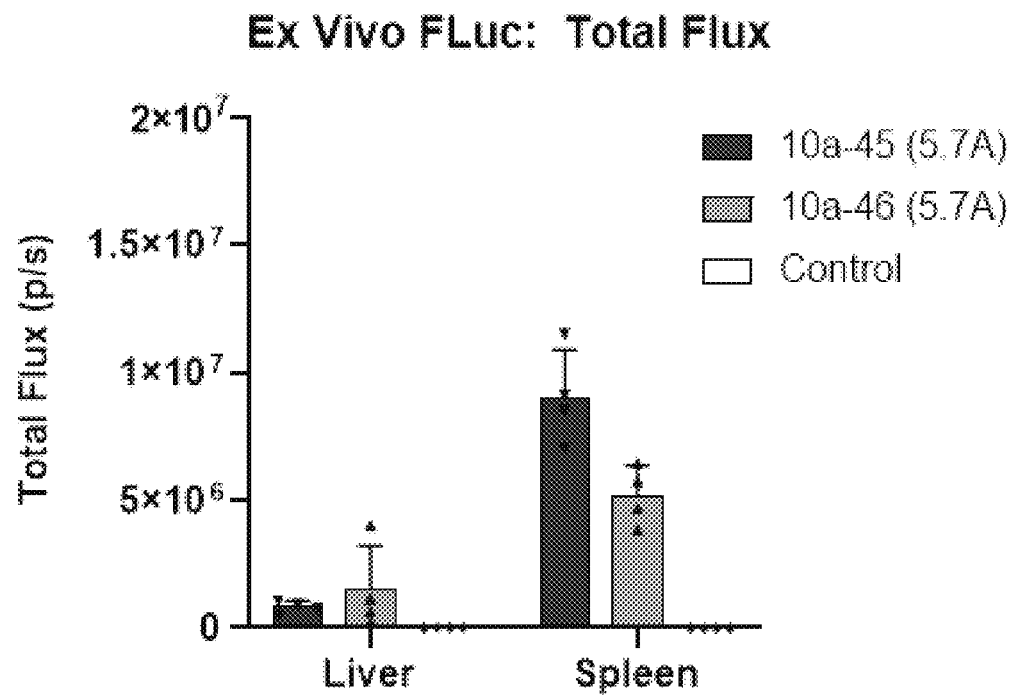
Figure 72D:
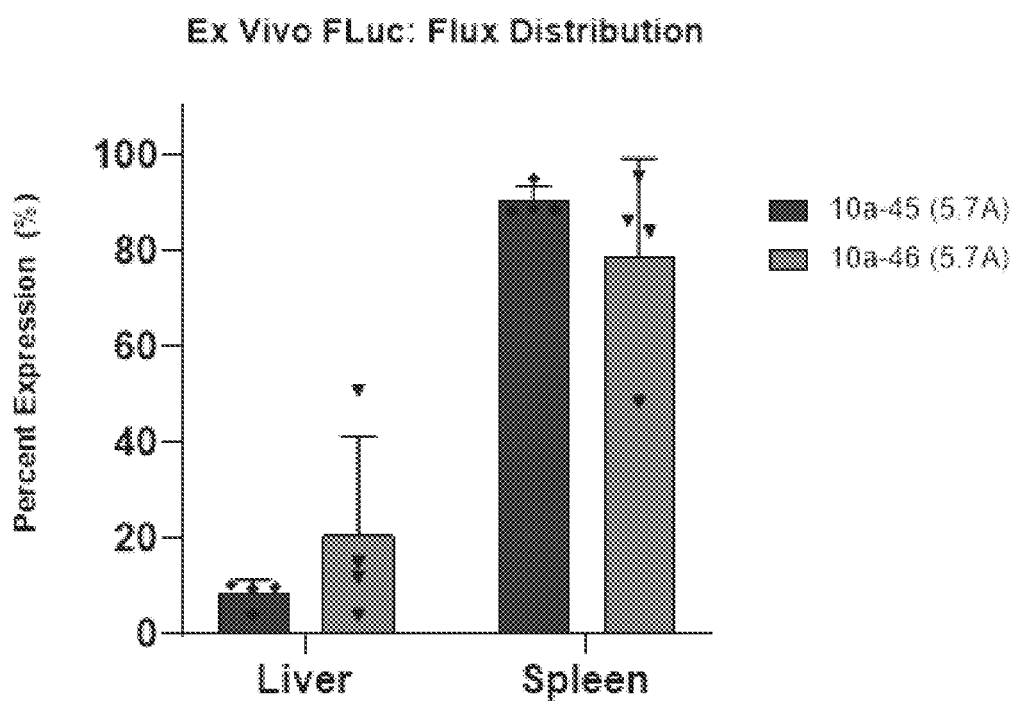

Lipid nanoparticles were formulated using Lipid 10a-46 or 10a-45 in a ionizable lipid:DOPE:cholesterol:DMG-PEG(2000) formulation ratio of 50:10:38.5:1.5 mol, and encapsulate the RNA molecule at a lipid-nitrogen-to-phosphate ratio (N:P) of 5.7. Expression of the RNA was present in all formulations. There was a greater total flux and percent expression within the spleen as shown in FIGS. 72C and 72D respectively.

| Formulation | Ionizable lipid | Helper lipid | PEG-lipid | Ionizable lipid:DOPE:Cholesterol:PEG-lipid (mol %) | Z-Average (nm) | PDI | RNA Encapsulation Efficiency (%) |
|---|---|---|---|---|---|---|---|
| 10a-45 (5.7A) | Lipid 10a-45 | DOPE | DMG-PEG(2000) | 50:10:38.5:1.5 | 74 | 0.04 | 95 |
| 10a-46 (5.7A) | Lipid 10a-46 | DOPE | DMG-PEG(2000) | 50:10:38.5:1.5 | 84 | 0.04 | 96 |

Example 74I: RbA Encapsulation, Total Flux, and Percent Expression In Vitro for Ionizable Lipid:DOPE:Cholesterol:DMG-PEG(2000) Formulation Ratio of 50:10:38.5:1.5 or for Ionizable Lipid: DSPCPcholesterol:$C_{14}$-PEG(2000) Formulation Ratio 35:16:46.2.5

Figure 72E:
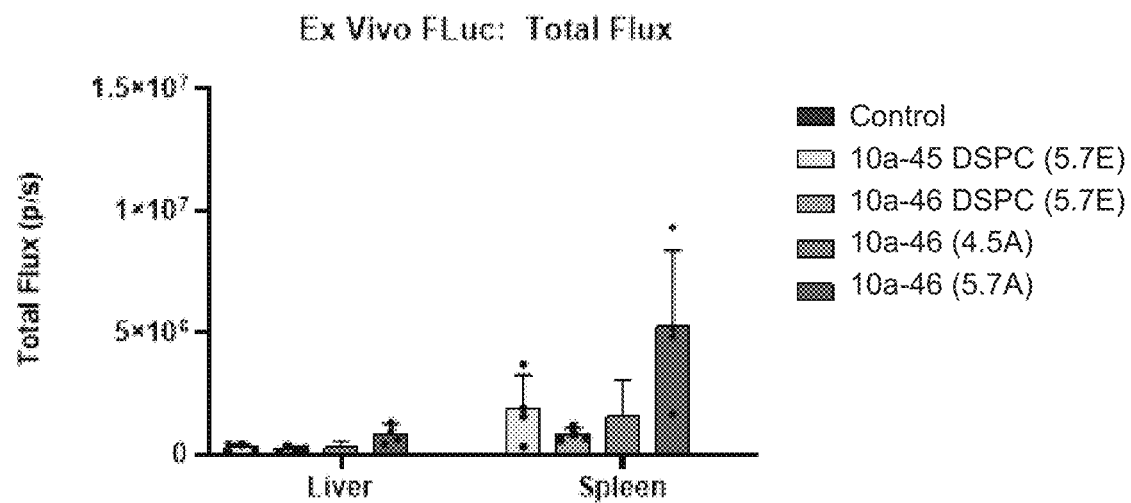
Figure 72F:
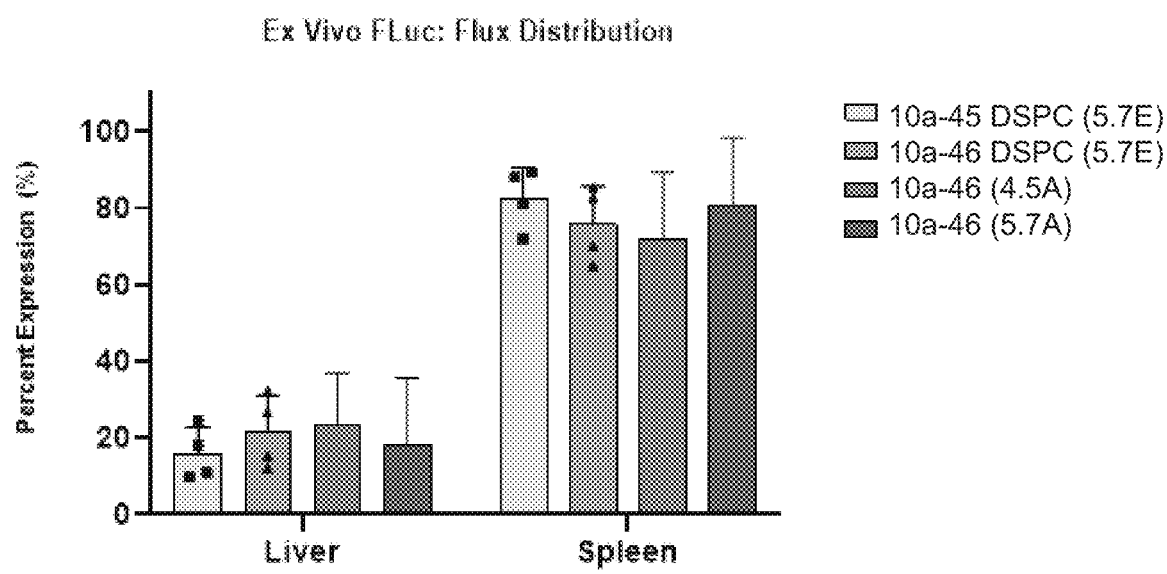

Lipid nanoparticles were formulated using Lipid 10a-45 or 10-a-46 in an ionizable lipid:DOPE:cholesterol:DMG-PEG(2000) formulation ratio of 50:10:38.5:1.5 mol % or in an ionizable lipid: DSPC:cholesterol:$C_{14}$-PEG(2000) formulation ratio of 35:16:46.2.5 mol, and encapsulate the RNA molecule at a lipid-nitrogen-to-phosphate ratio (N:P) of 5.7 or 4.5. Expression of the RNA was present in all formulations. There was a greater total flux and percent expression within the spleen as shown in FIGS. 72E and 72F respectively.

| Formulation | Ionizable lipid | Helper lipid | PEG-lipid | Ionizable lipid:Helper lipid:Cholesterol:PEG-lipid (mol %) | Z-Average (nm) | PDI | RNA Encapsulation Efficiency (%) |
|---|---|---|---|---|---|---|---|
| 10a-45 DSPC (5.7E) | Lipid 10a-45 | DSPC | C$_{14}$-PEG(2000) | 35:16:46.2.5 | 56 | 0.22 | 94 |
| 10a-46 DSPC (5.7E) | Lipid 10a-46 | DSPC | C$_{14}$-PEG(2000) | 35:16:46.2.5 | 68 | 0.02 | 95 |
| 10a-46 (4.5A) | Lipid 10a-46 | DOPE | DMG-PEG(2000) | 50:10:38.5:1.5 | 91 | 0.13 | 93 |
| 10a-46 (5.7A) | Lipid 10a-46 | DOPE | DMG-PEG(2000) | 50:10:38.5:1.5 | 76 | 0.06 | 93 |

Example 74E: RNTA Encapsulation, Total Flux, and Percent Expression In Vitro for Ionizable Lipid:DOPE:Cholesterol:DSPE-PEG(2000) Formulation Ratio of 62:4:33:1 or for Ionizable Lipid:DSPC:Cholesterol:DMG-PEG(2000) Formulation Ratio of 50:10:38.5:1.5

Figure 72G:
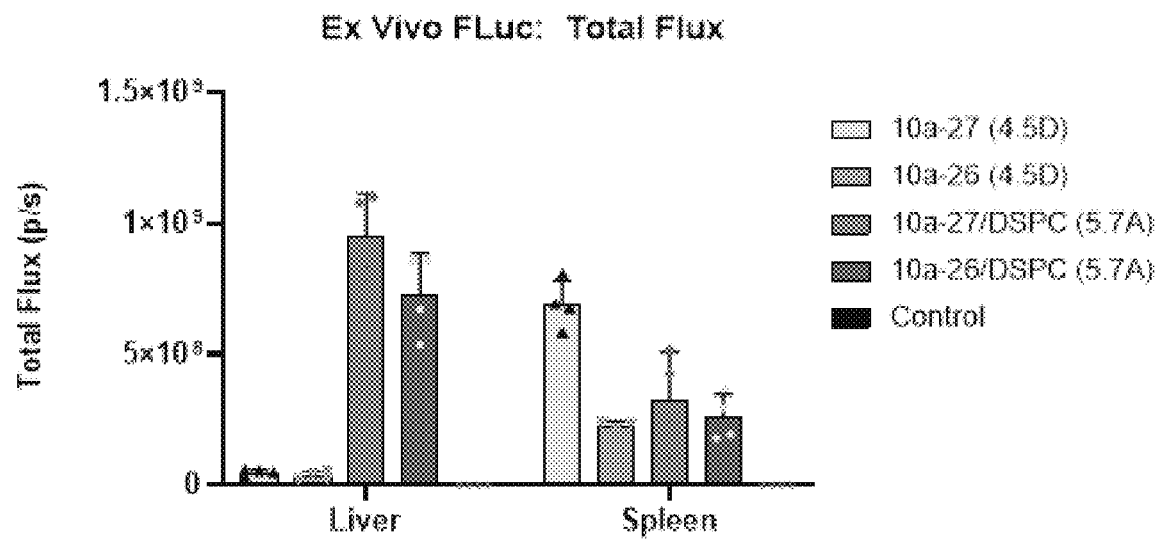
Figure 72H:
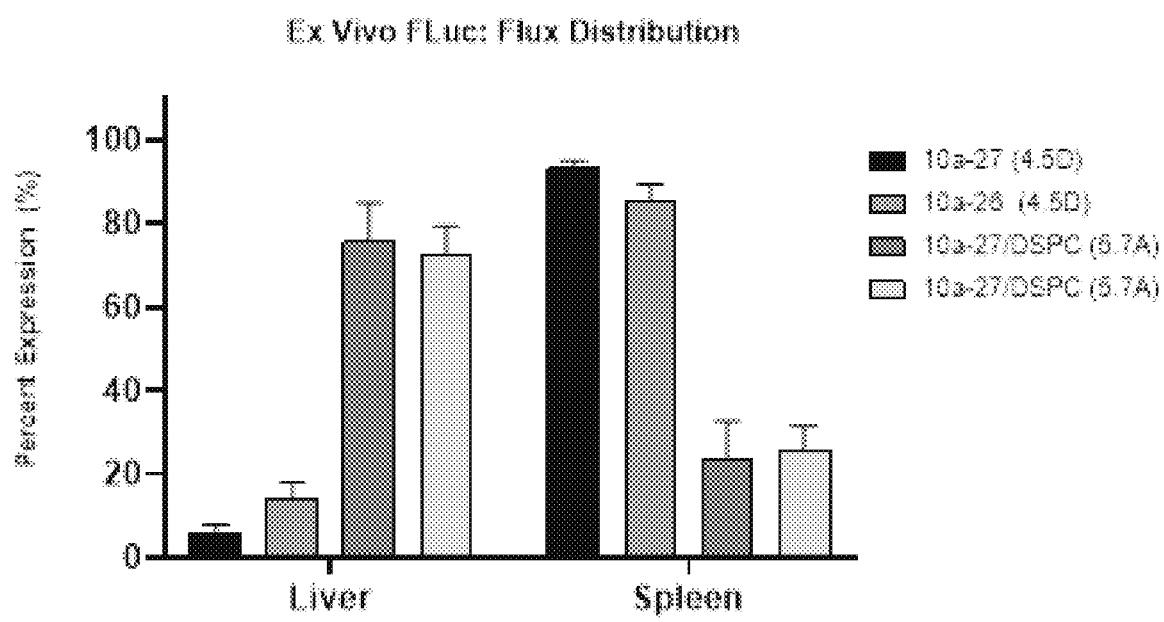

Lipid nanoparticles were formulated using Lipid 10a-26 or 10a-27 in a ionizable lipid:DOPE:cholesterol:DSPE-PEG (2000) formulation ratio of 62:4:33:1 mol % (encapsulating the RNA molecule at a N:P ratio of 4.5) or ionizable lipid:DSPC:cholesterol:DMG-PEG(2000) formulation ratio of 50:10:38.5:1.5 mol % (encapsulating the RNA molecule at a N:P ratio of 5.7). Expression of the RNA was present in all formulations. There was a greater total flux and percent expression within the spleen as shown in FIGS. 72G and 72H respectively.

| Formulation | Ionizable lipid | Helper lipid | PEG-lipid | Ionizable lipid:Helper lipid:Cholesterol:PEG-lipid (mol %) | Z-Average (nm) | PDI | RNA Encapsulation Efficiency (%) |
|---|---|---|---|---|---|---|---|
| 10a-27 (4.5D) | Lipid 10a-27 | DOPE | DSPE-PEG(2000) | 62:4:33:1 | 82 | 0.06 | 94 |
| 10a-26 (4.5D) | Lipid 10a-26 | DOPE | DSPE-PEG(2000) | 62:4:33:1 | 68 | 0.08 | 91 |
| 10a-27 DSPC (5.7A) | Lipid 10a-27 | DSPC | DMG-PEG(2000) | 50:10:38.5:1.5 | 79 | 0.06 | 96 |
| 10a-26 DSPC (5.7A) | Lipid 10a-26 | DSPC | DMG-PEG(2000) | 50:10:38.5:1.5 | 79 | 0.05 | 93 |

Example 74F: RNA Encapsulation, Total Flux, and Percent Expression In Vitro for Ionizable Lipid:DOPE:Cholesterol:DMG-PEG(2000) Formulation Ratio of 50:10:38.5:1.5

Lipid nanoparticles were formulated using Lipid 10a-26, 10a-27, or 10a-130 and/or Lipid 3-III-1 (represented by

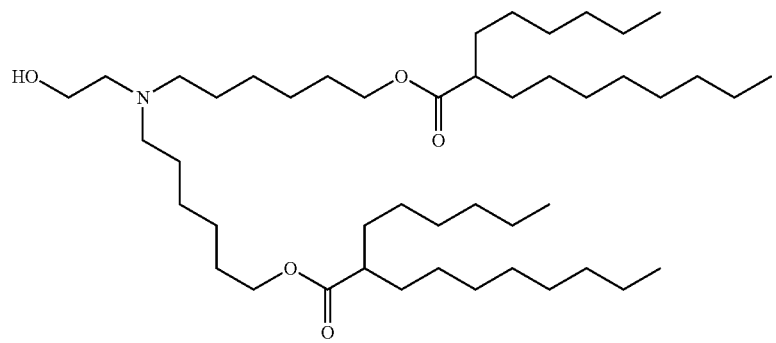

Figure 72I:
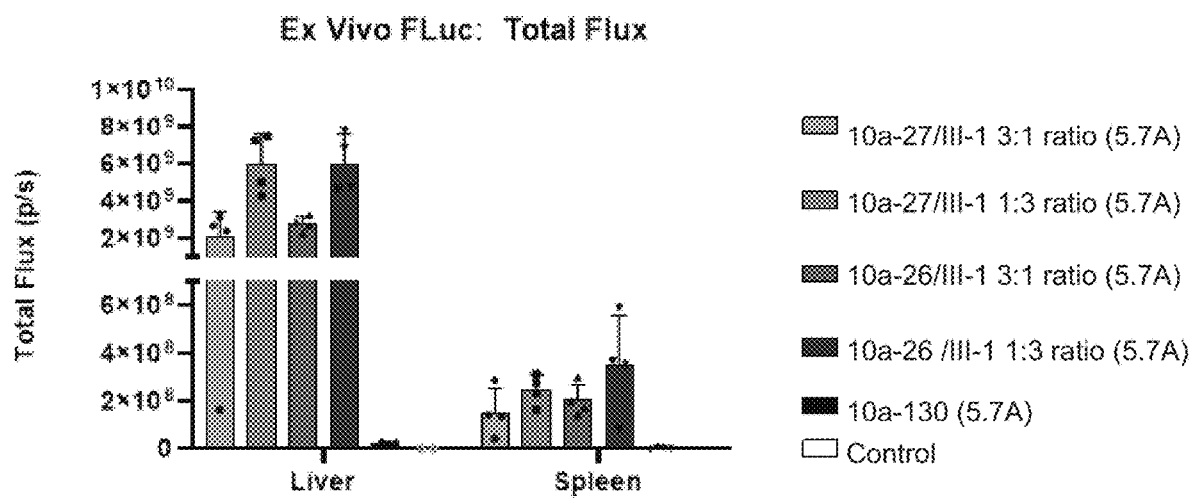
Figure 72J:
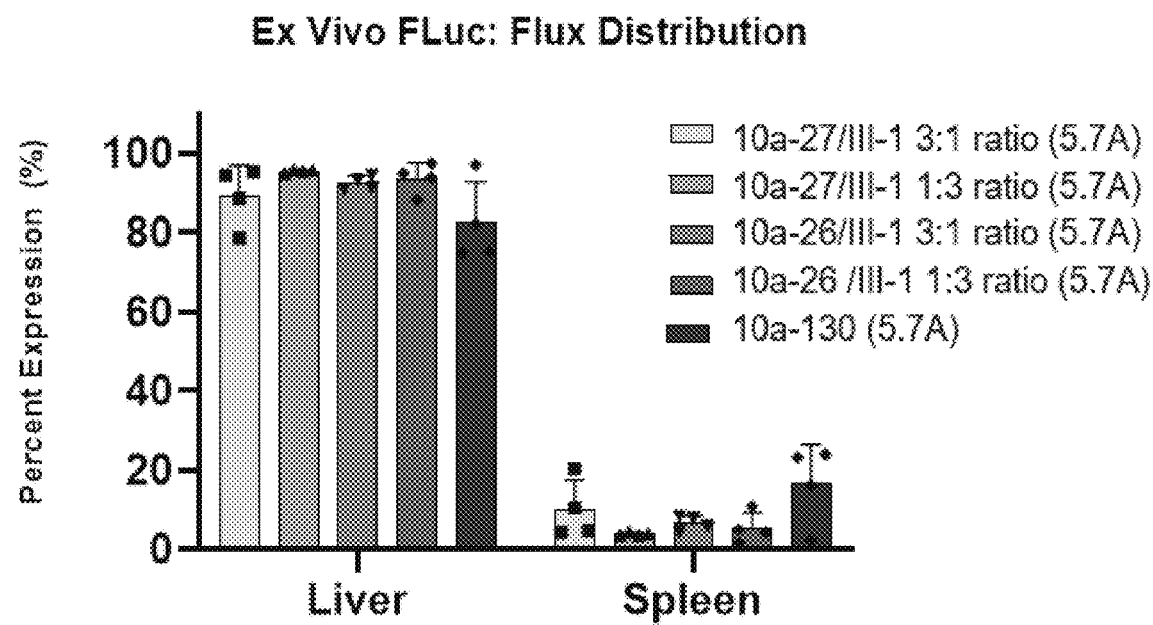

) in a ionizable lipid:DSPC:cholesterol:DMG-PEG(2000) formulation ratio of 50:10:38.5:1.5 mol %, and encapsulate the RNA molecule at a N:P ratio of 5.7. Expression of the RNA was present in all formulations. There was a greater total flux and percent expression within the liver as shown in FIGS. 72I and 72J respectively.

TNS and the particle's $pK_a$ was also calculated. 5 μL of 60 μg/mL 2-(p-toluidino) naphthalene-6-sulfonic acid (TNS) and 5 μL of 30 μg of RNA/mL lipid nanoparticles were added in to wells with HEPES buffer ranging from pH 2-12. The mixture was then shaken at room temperature for 5 minutes, and read for fluorescence (excitation 322 nm, emission 431 nm) using a plate reader. The inflection point of the fluorescence signal was calculated to determine the particle's $pK_a$.

| Formulation | Ionizable lipid | Helper lipid | PEG-lipid | Ionizable lipid:Helper lipid:Cholesterol:PEG-lipid (mol %) | Z-Average (nm) | PDI | EE (%) | Conc. (ug/mL) | pKa |
|---|---|---|---|---|---|---|---|---|---|
| 10a-27/III-1 (5.7A) | Lipid 10a-27/ Lipid 3-III-1 3:1 ratio | DOPE | DMG-PEG(2000) | 50:10:38.5:1.5 | 74 | 0 | 96 | 55.8 | 7.4 |
| 10a-27III-1 (5.7A) | Lipid 10a-27/ Lipid 3-III-11:3 ratio | DOPE | DMG-PEG(2000) | 50:10:38.5:1.5 | 85 | 0.1 | 93 | 51.9 | 6.3 |
| 10a-26/III-1 (5.7A) | Lipid 10a-26/ Lipid 3-III-13:1 ratio | DOPE | DMG-PEG(2000) | 50:10:38.5:1.5 | 87 | 0.1 | 94 | 51.7 | 6.8 |
| 10a-26/III-1 (5.7A) | Lipid 10a-26/ Lipid 3-III-11:3 ratio | DOPE | DMG-PEG(2000) | 50:10:38.5:1.5 | 97 | 0.1 | 90 | 53.1 | 6.2 |
| 10a-130 (5.7A) | Lipid 10a-130 | DOPE | DMG-PEG(2000) | 50:10:38.5:1.5 | 60 | 0.1 | 89 | 53.8 | 6.7 |

Example 74G: RNTA Encapsulation, Total Flux, and Percent Expression In Vitro for Ionizable Lipid:DOPE:Cholesterol:DSPE-PEG(2000) Formulation Ratio of 62:4:33:1 or for Ionizable Lipid:DSPC:Cholesterol:DMG-PEG(2000) Formulation Ratio of 50:10:38.5:1.5

Figure 72K:
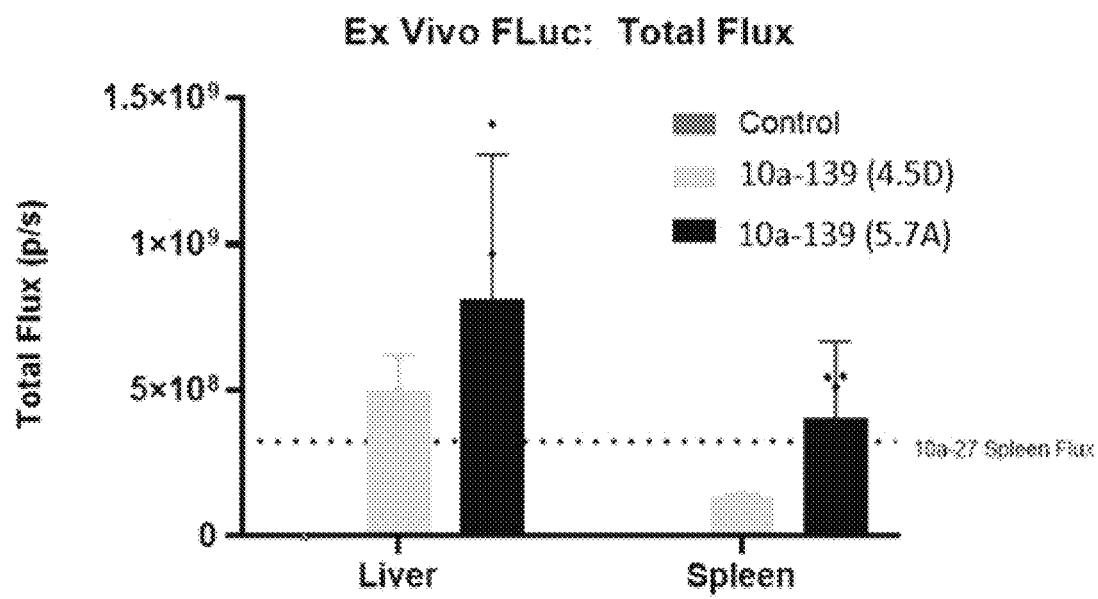
Figure 72L:
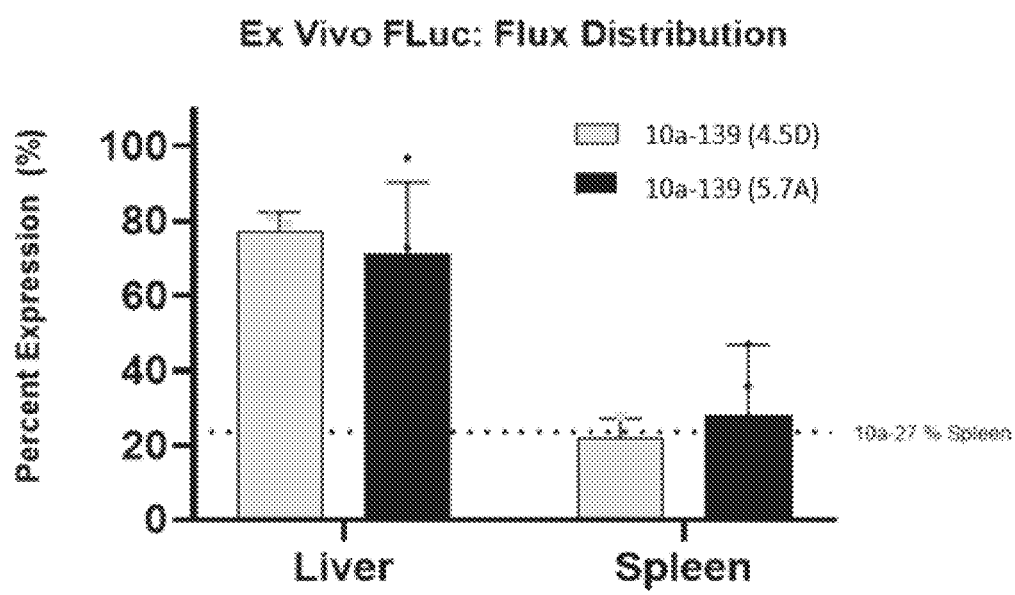
Figure 73A:
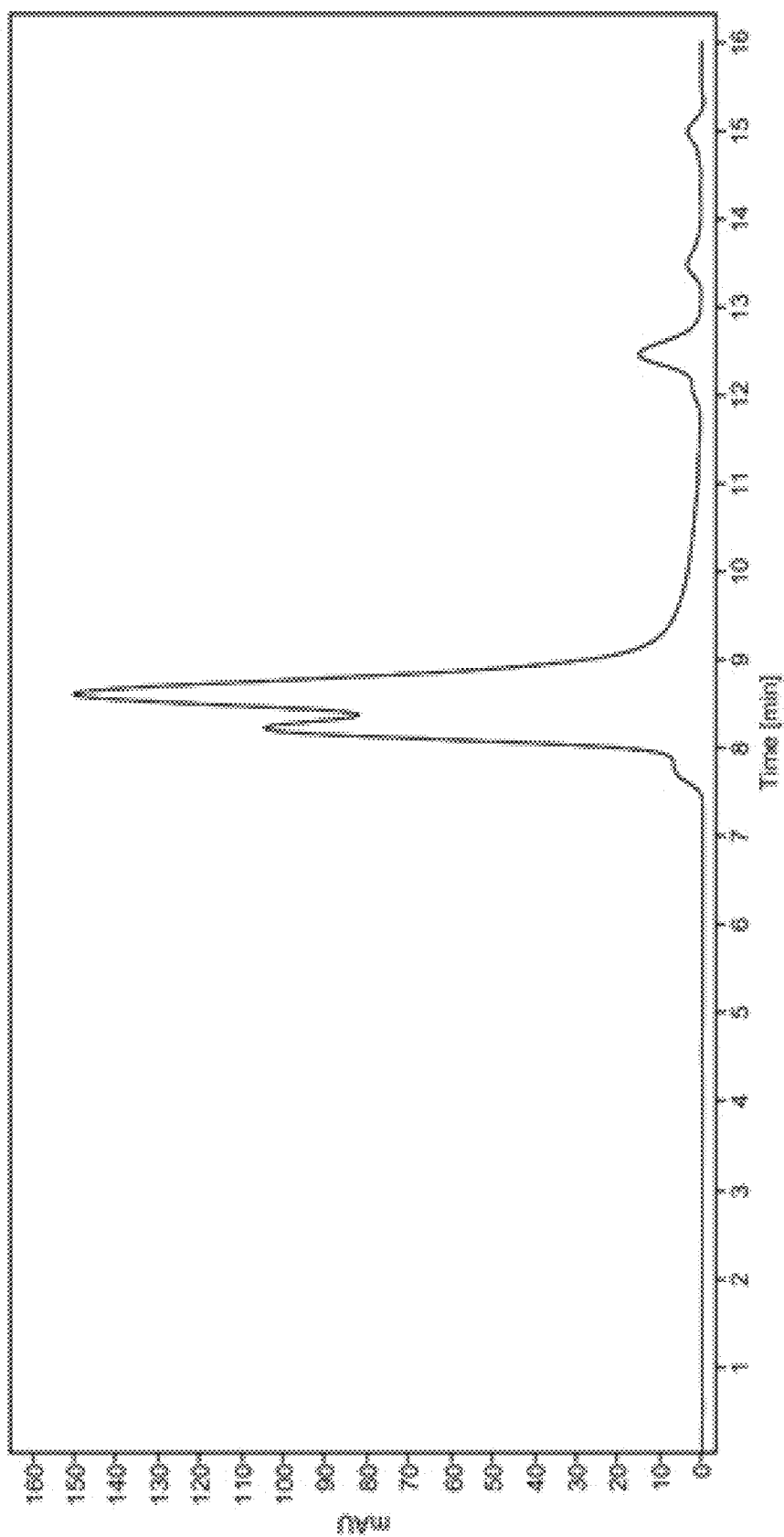
FIGS. 73A-73C show circularization efficiency of an RNA molecule encoding a stabilized (double proline mutant) SARS-CoV2 spike protein.
Figure 73B:
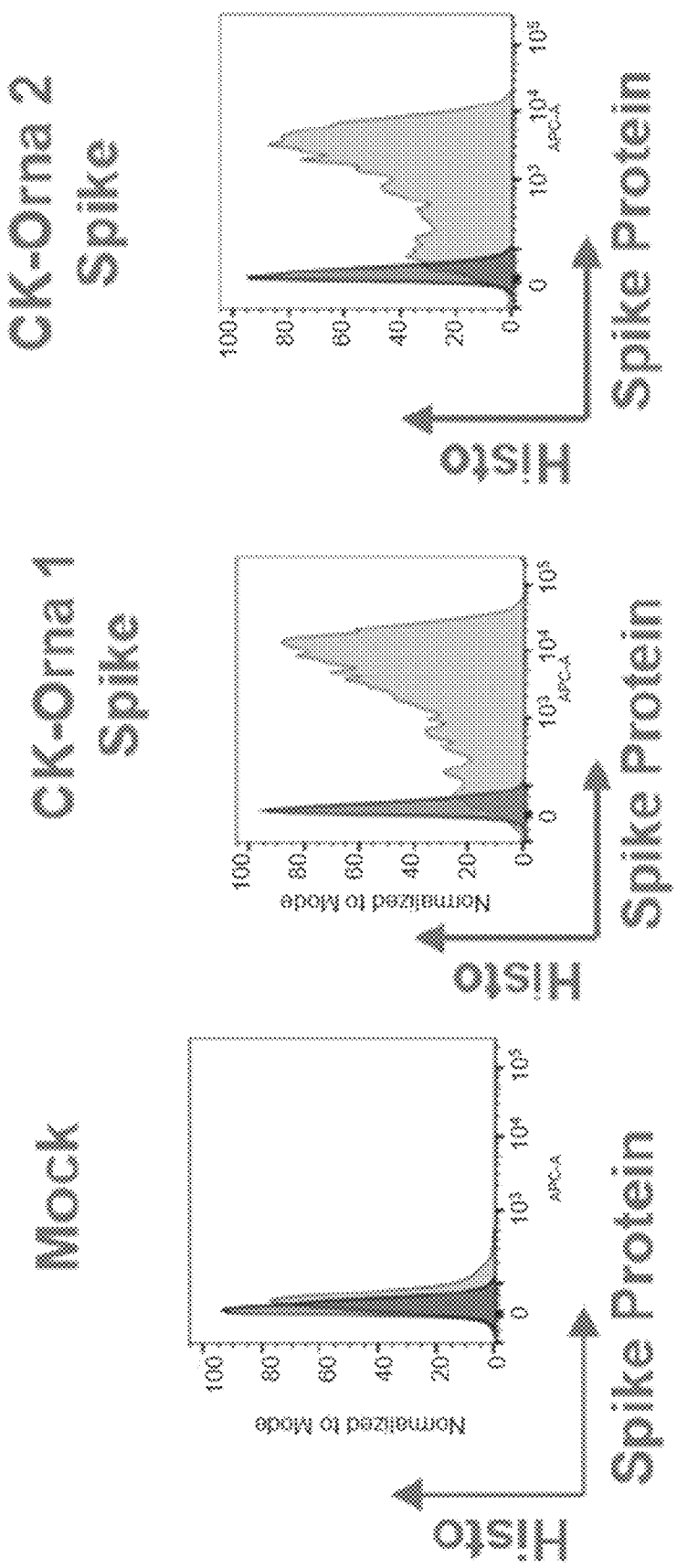
Figure 73C:
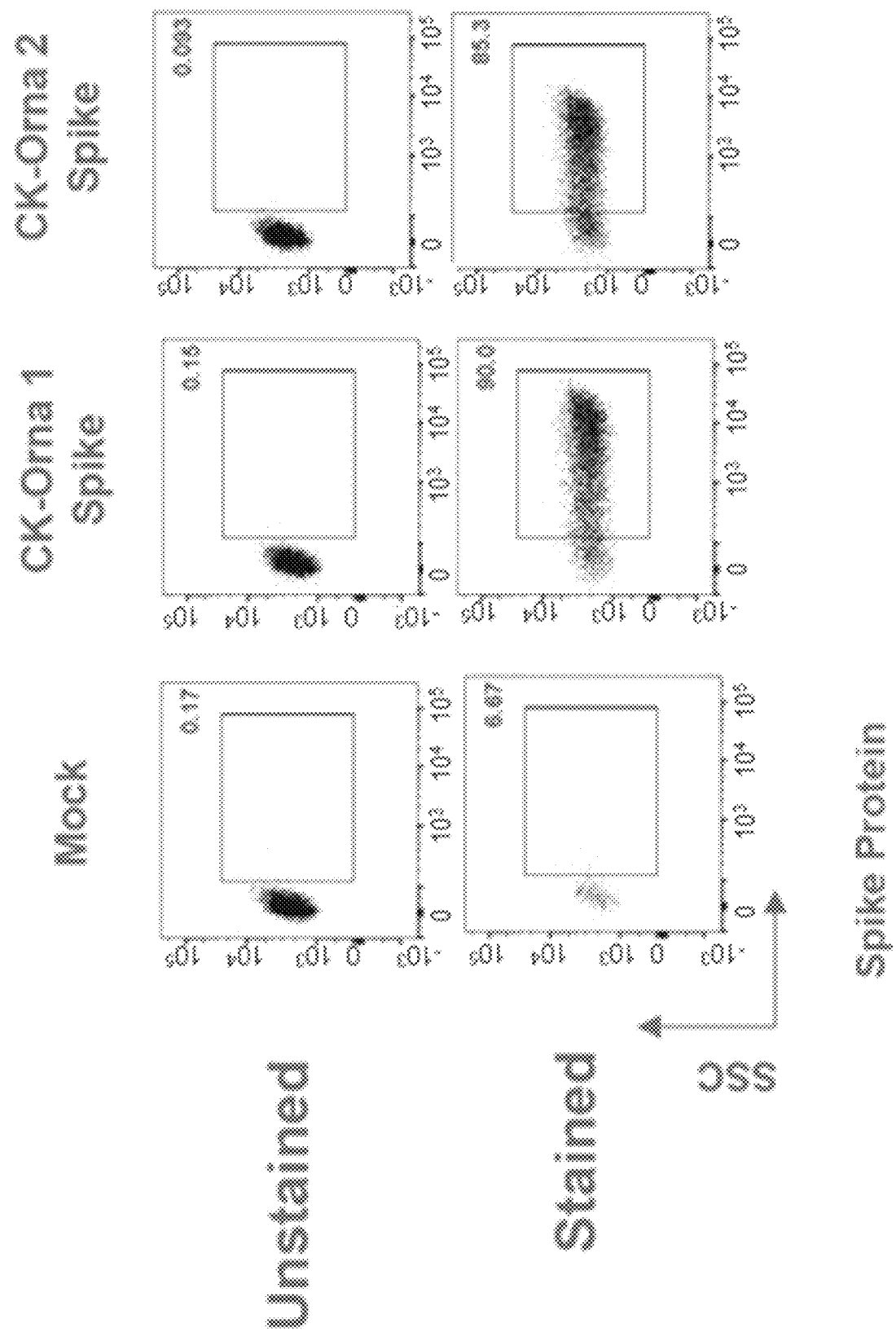
Figure 74:
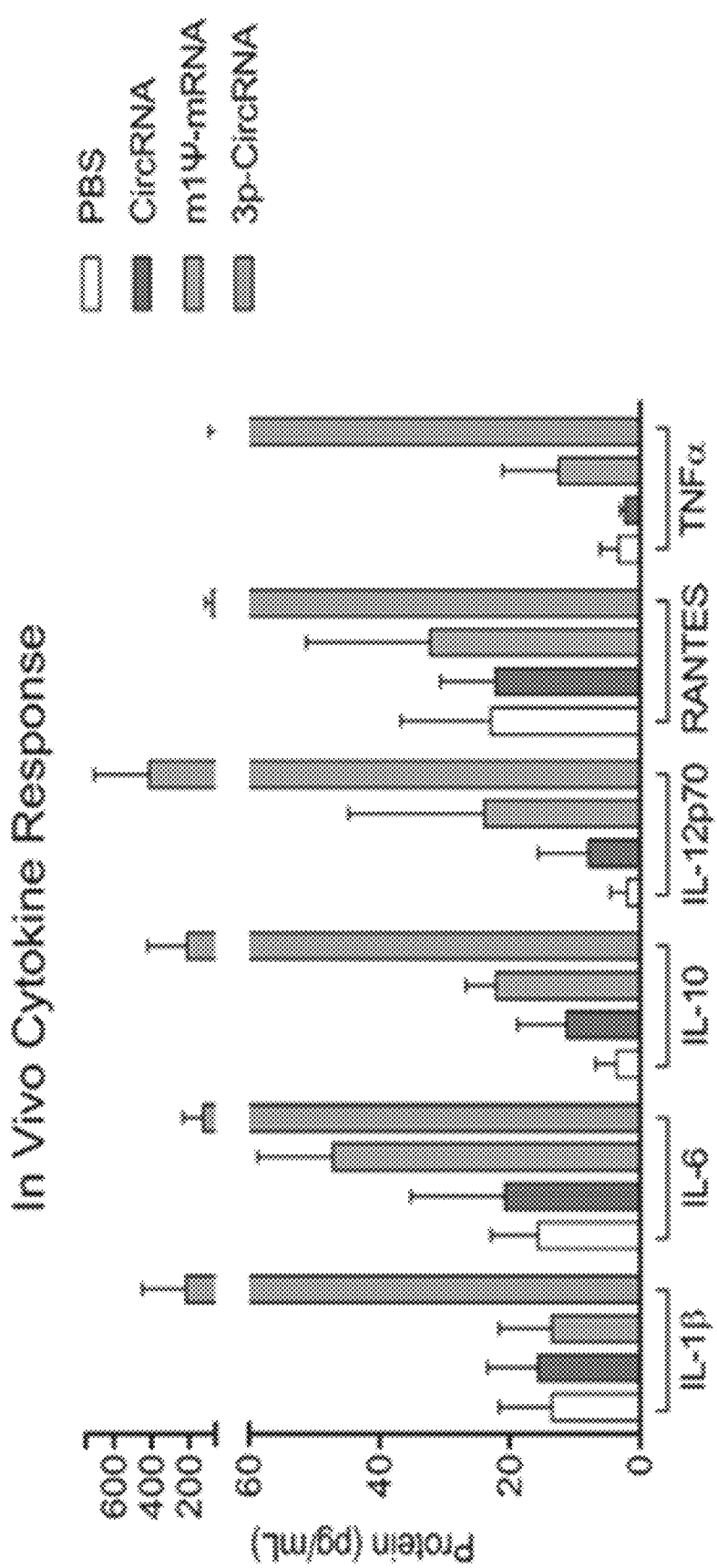
FIG. 74 provides multiple controlled adjuvant strategies. CircRNA as indicated on the figure entails an unpurified sense circular RNA splicing reaction using GTP as an indicator molecule in vitro. 3p-circRNA entails a purified sense circular RNA as well as a purified antisense circular RNA mixed containing triphosphorylated 5' termini. Bars show in vivo cytokine response to formulated circRNA generated using the indicated strategy.

Lipids nanoparticles were formulated using Lipid 10a-139 in a ionizable lipid:DOPE:cholesterol:DSPE-PEG (2000) formulation ratio of 62:4:33:1 mol % (encapsulating the RNA molecule at a N:P ratio of 4.5) or ionizable lipid:DOPE:cholesterol:DMG-PEG(2000) formulation ratio of 50:10:38.5:1.5 mol % (encapsulating the RNA molecule at a N:P ratio of 5.7). Expression of the RNA was present in all formulations. There was a greater total flux and percent expression within the liver as shown in FIGS. 72K and 72L respectively.

| Formulation | Ionizable lipid | Helper lipid | PEG-lipid | Ionizable lipid:Helper lipid:Cholesterol:PEG-lipid (mol %) | Z-Average (nm) | PDI | EE (%) |
|---|---|---|---|---|---|---|---|
| 10a-139 (4.5D) | Lipid 10a-139 | DOPE | DSPE-PEG(2000) | 62:4:33:1 | 93 | 0.01 | 79 |
| 10a-139 (5.7A) | Lipid 10a-139 | DSPC | DMG-PEG(2000) | 50:10:38.5:1.5 | 122 | 0.02 | 95 |

Example 75

Figure 75A:
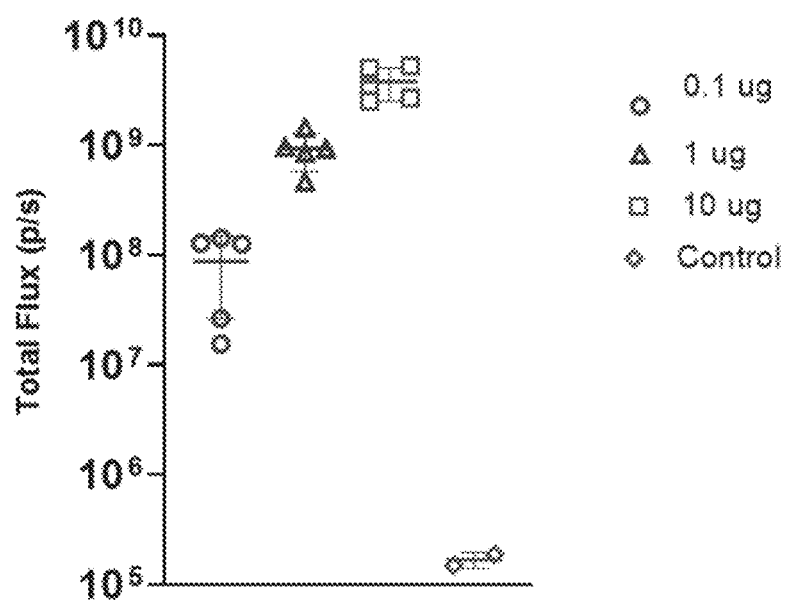
FIGS. 75A-75C illustrate an intramuscular delivery of LNP containing circular RNA constructs.
Figure 75B:
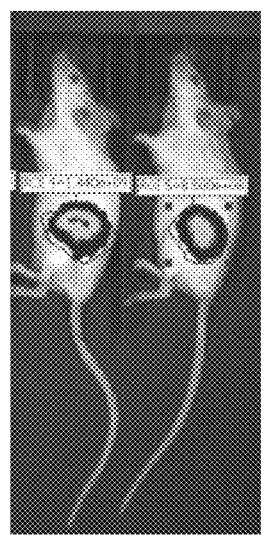
Figure 75C:
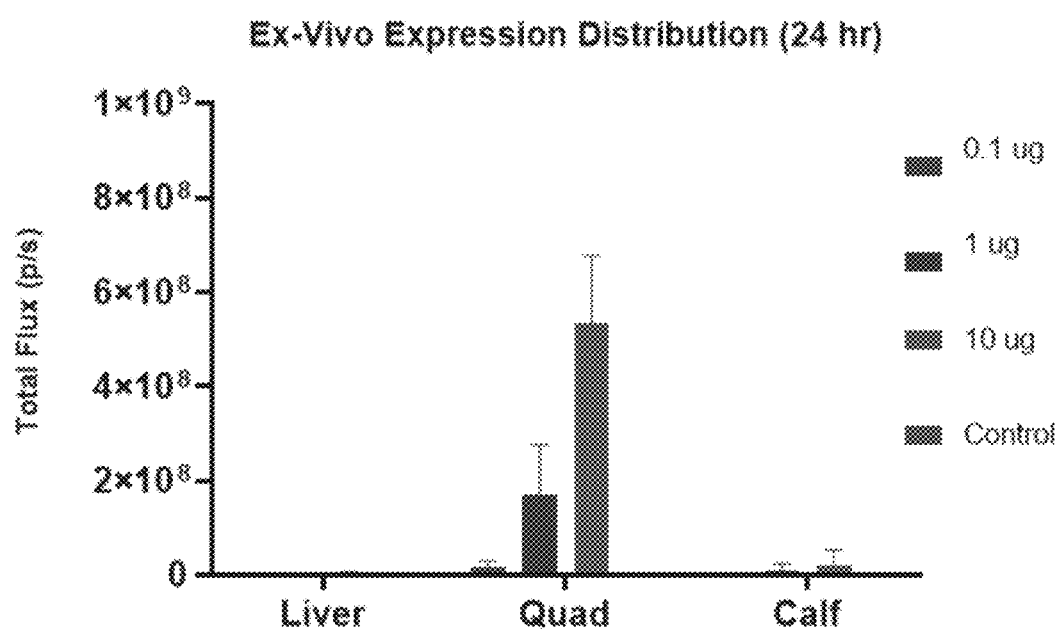
Figure 76A:
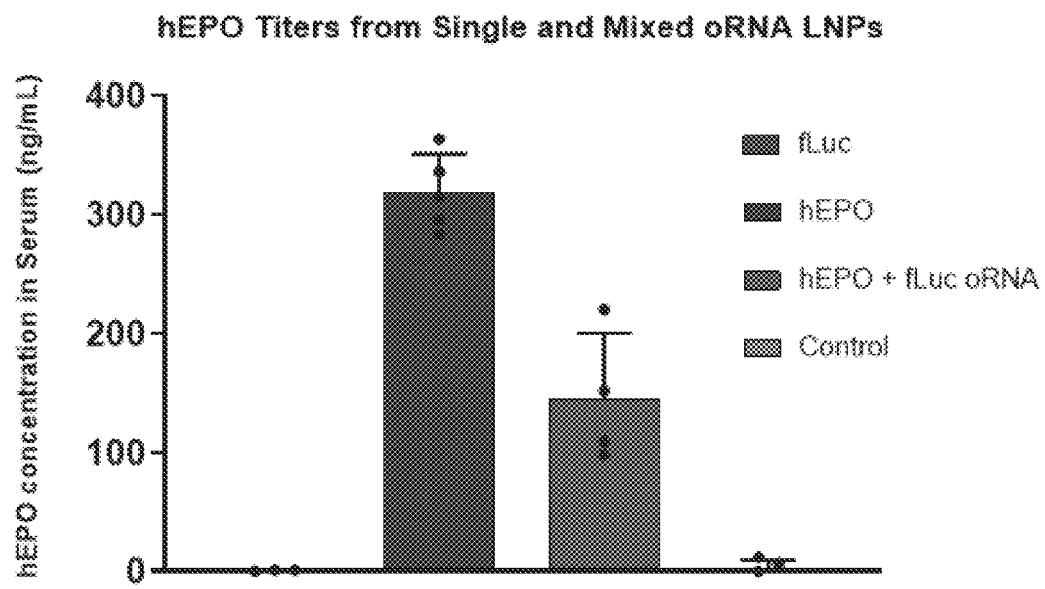
FIGS. 76A and 76B illustrate expression of multiple circular RNAs from a single lipid formulation.
Figure 76B:
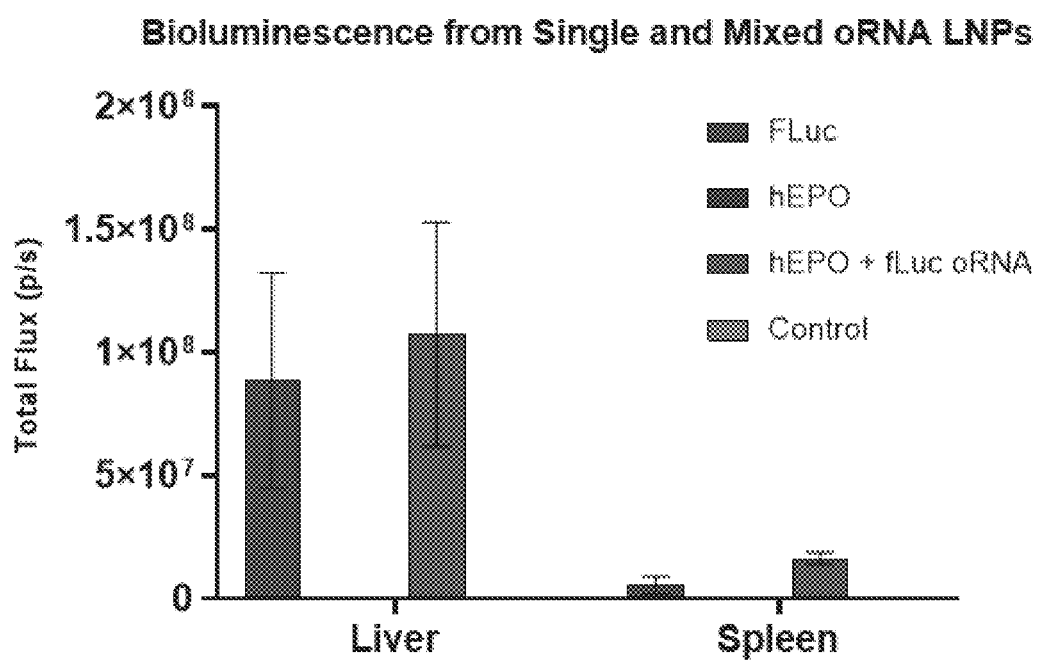
Figure 77A:
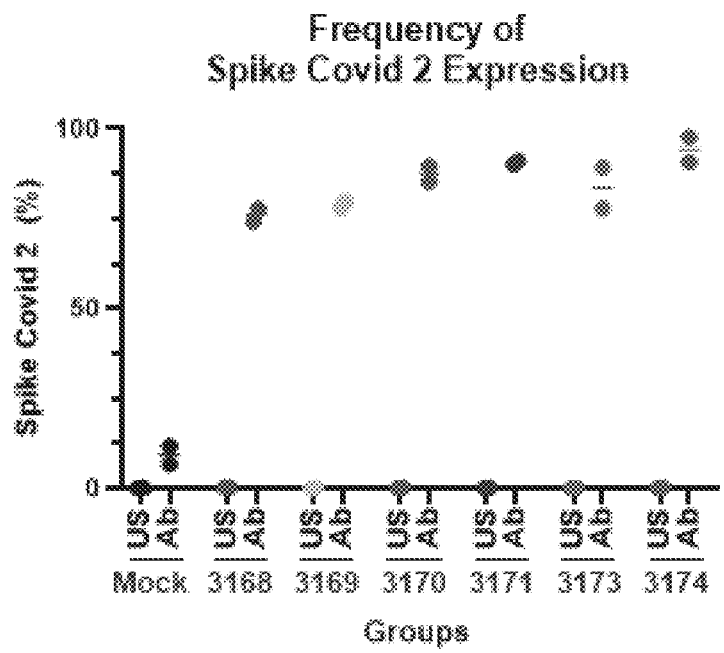
FIGS. 77A-77C illustrate SARS-CoV2 spike protein expression of circular RNA encoding spike SARS-CoV2 proteins.
Figure 77B:
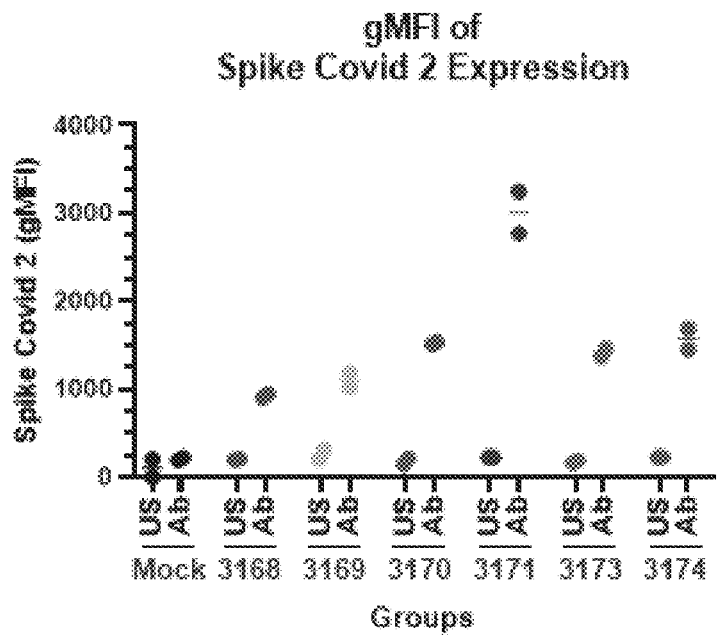
Figure 77C:
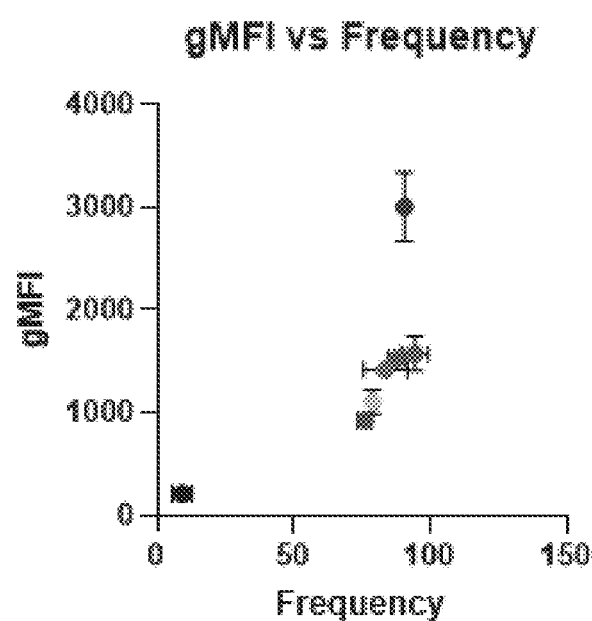
Figure 78:
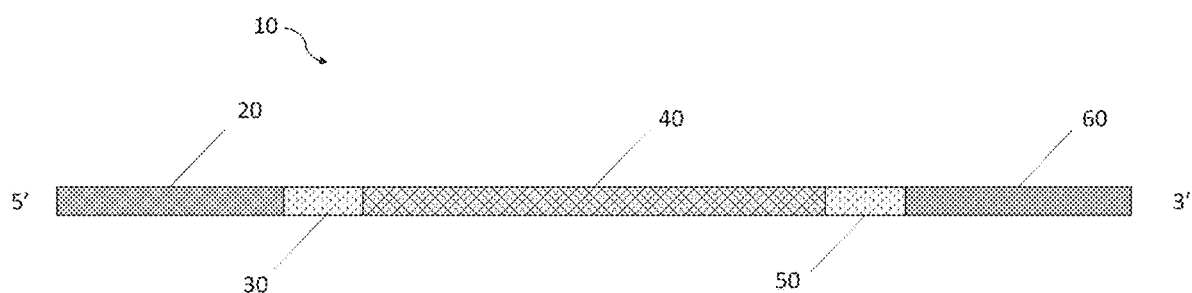
FIG. 78 depicts a general sequence construct of a linear RNA polynucleotide precursor (10). The sequence as provided is illustrated in a 5' to 3' order of a 5' enhanced intron element (20), a 5' enhanced exon element (30), a core functional element (40), a 3' enhanced exon element (50) and a 3' enhanced intron element (60).
Figure 79:
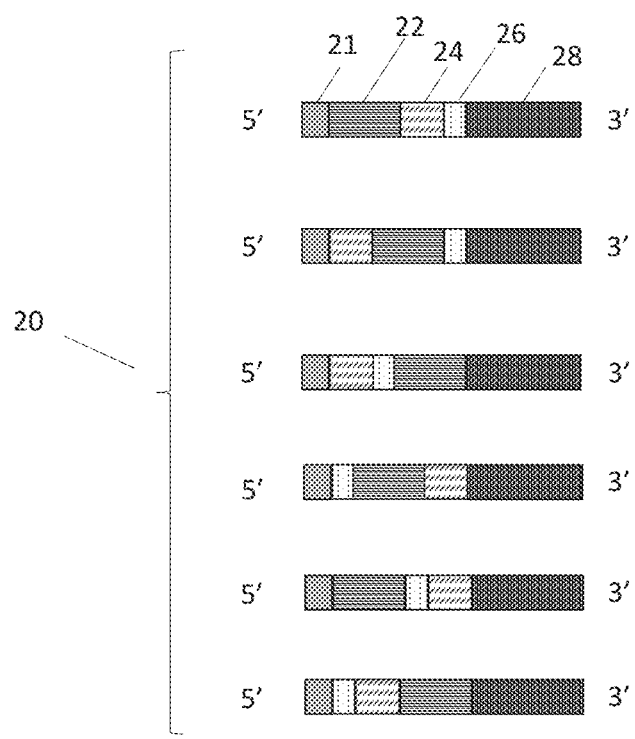
FIG. 79 depicts various exemplary iterations of the 5' enhanced exon element (20). As illustrated, one iteration of the 5' enhanced exon element (20) comprises in a 5' to 3' order in the following order: a leading untranslated sequence (21), a 5' affinity tag (22), a 5' external duplex region (24), a 5' external spacer (26), and a 3' intron fragment (28).
Figure 80:
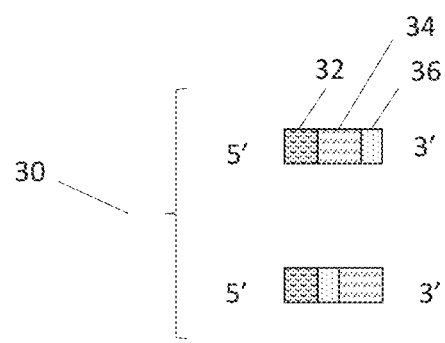
FIG. 80 depicts various exemplary iterations of the 5' enhanced exon element (30). As illustrated, one iteration of the 5' enhanced exon element (30) comprises in a 5' to 3' order: a 3' exon fragment (32), a 5' internal duplex region (34), and a 5' internal spacer (36).
Figure 81:
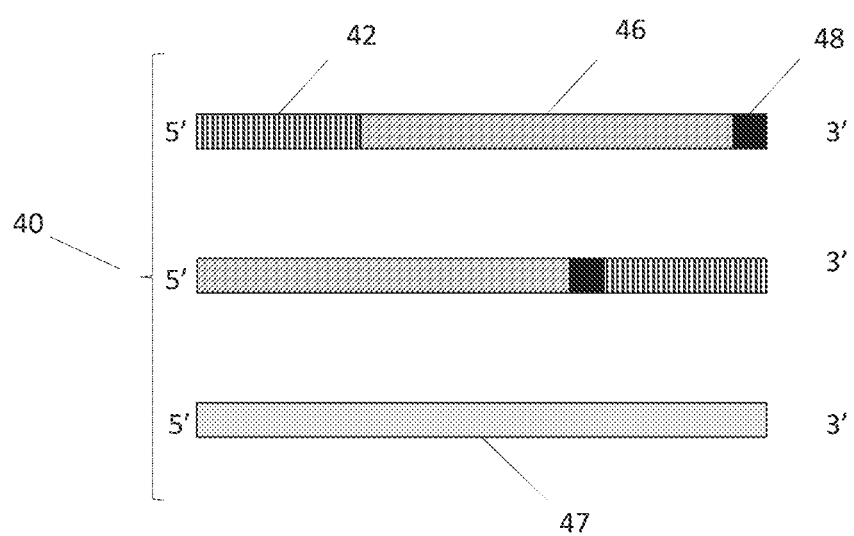
FIG. 81 depicts various exemplary iterations of the core functional element (40). As illustrated, one iteration of the core functional element (40) comprises a TIE (42), a coding region (46) and a stop region (e.g., a stop codon or stop cassette) (48). Another iteration is illustrated to show the core functional element (47) comprising a noncoding region (47).
Figure 82:
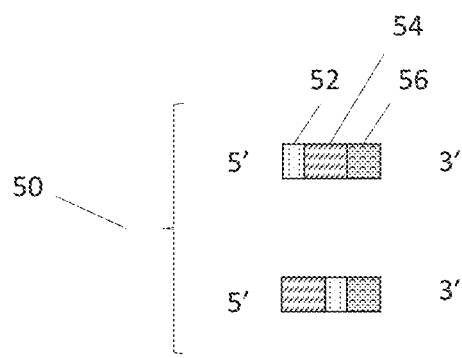
FIG. 82 depicts various exemplary iterations of the 3' enhanced exon element (50). As illustrated, one of the iterations of the 3' enhanced exon element (50) comprises, in the following 5' to 3' order: a 3' internal spacer (52), a 3' internal duplex region (54), and a 5' exon fragment (56).
Figure 83:
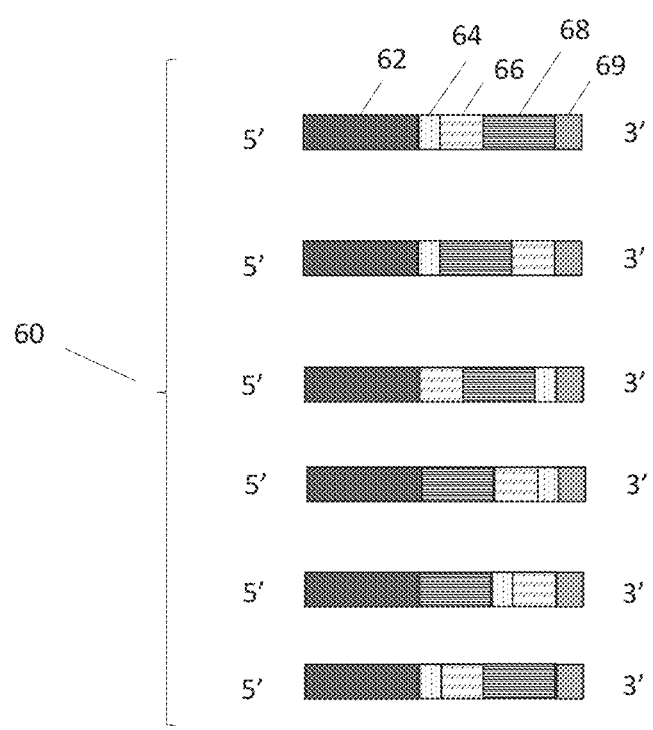
FIG. 83 depicts various exemplary iterations of the 3' enhanced intron element (60). As illustrated, one of the iterations of the 3' enhanced intron element (60) comprises, in the following order, a 5' intron fragment (62), a 3' external spacer (64), a 3' external duplex region (66), a 3' affinity tag (68) and a terminal untranslated sequence (69).
Figure 84:
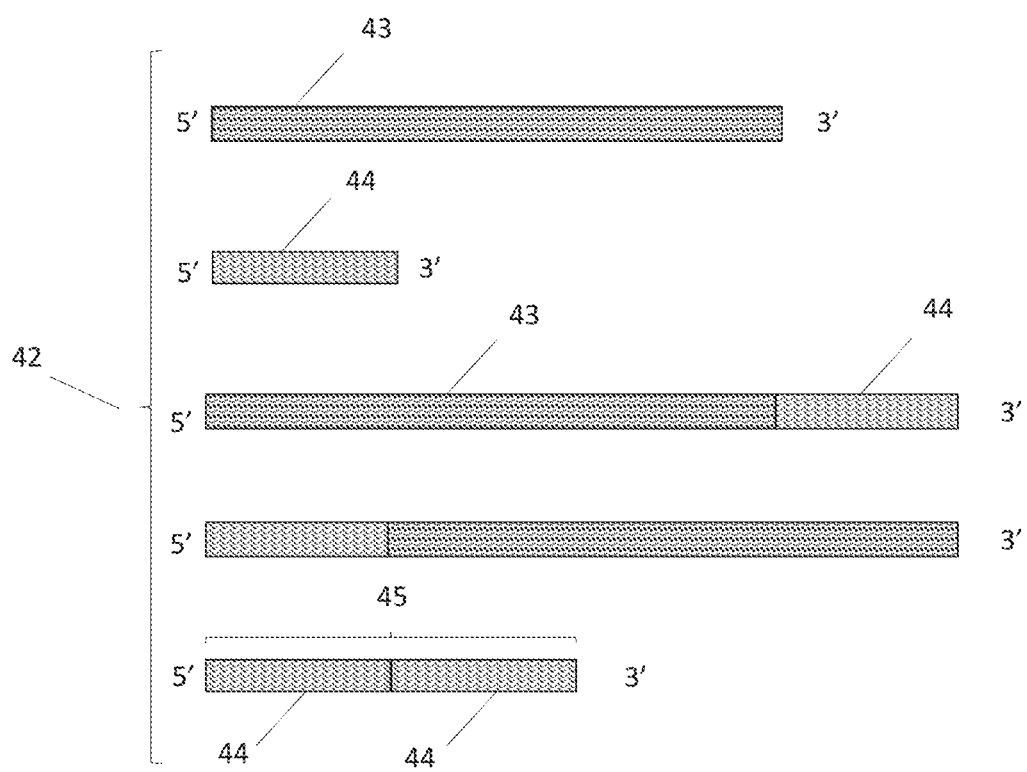
FIG. 84 depicts various exemplary iterations a translation initiation element (TIE) (42). TIE (42) sequence as illustrated in one iteration is solely an IRES (43). In another iteration, the TIE (42) is an aptamer (44). In two different iterations, the TIE (42) is an aptamer (44) and IRES (43) combination. In another iteration, the TIE (42) is an aptamer complex (45).
Figure 85:
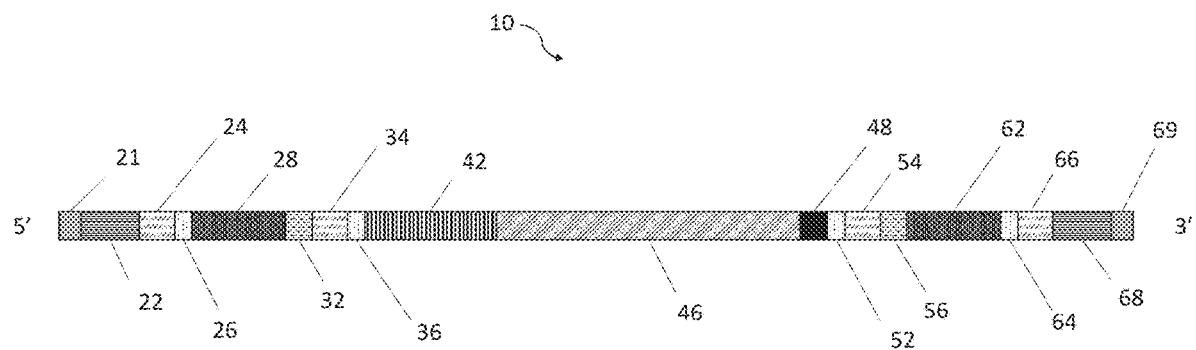
FIG. 85 illustrates an exemplary linear RNA polynucleotide precursor (10) comprising in the following 5' to 3' order, a leading untranslated sequence (21), a 5' affinity tag (22), a 5' external duplex region (24), a 5' external spacer (26), a 3' intron fragment (28), a 3' exon fragment (32), a 5' internal duplex region (34), a 5' internal spacer (36), a TIE (42), a coding element (46), a stop region (48), a 3' internal spacer (52), a 3' internal duplex region (54), a 5' exon fragment (56), a 5' intron fragment (62), a 3' external spacer (64), a 3' external duplex region (66), a 3' affinity tag (68) and a terminal untranslated sequence (69).
Figure 86:
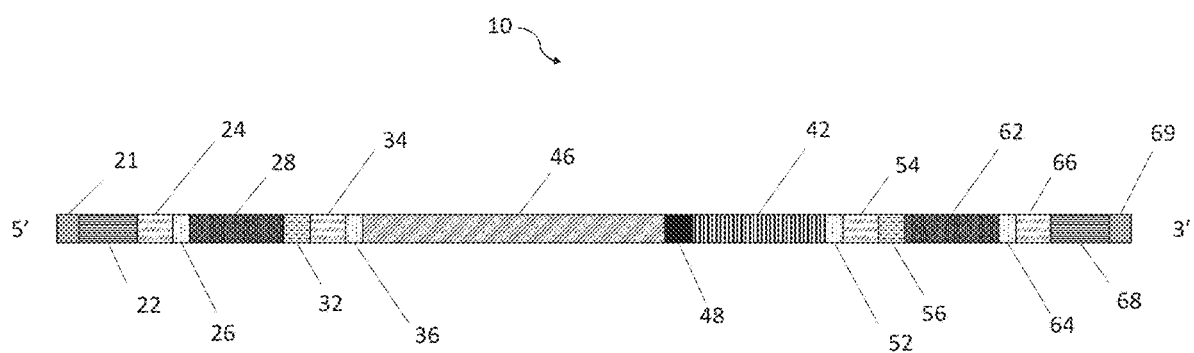
FIG. 86 illustrates an exemplary linear RNA polynucleotide precursor (10) comprising in the following 5' to 3' order, a leading untranslated sequence (21), a 5' affinity tag (22), a 5' external duplex region (24), a 5' external spacer (26), a 3' intron fragment (28), a 3' exon fragment (32), a 5' internal duplex region (34), a 5' internal spacer (36), a coding element (46), a stop region (48), a TIE (42), a 3' internal spacer (52), a 3' internal duplex region (54), a 5' exon fragment (56), a 5' intron fragment (62), a 3' external spacer (64), a 3' external duplex region (66), a 3' affinity tag (68) and a terminal untranslated sequence (69).
Figure 87:
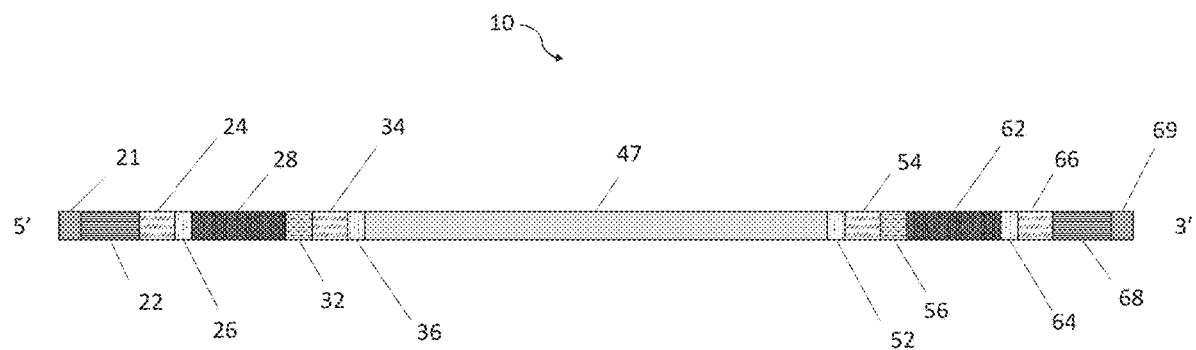
FIG. 87 illustrates an exemplary linear RNA polynucleotide precursor (10) comprising in the following 5' to 3' order, a leading untranslated sequence (21), a 5' affinity tag (22), a 5' external duplex region (24), a 5' external spacer (26), a 3' intron fragment (28), a 3' exon fragment (32), a 5' internal duplex region (34), a 5' internal spacer (36), a noncoding element (47), a 3' internal spacer (52), a 3' internal duplex region (54), a 5' exon fragment (56), a 5' intron fragment (62), a 3' external spacer (64), a 3' external duplex region (66), a 3' affinity tag (68) and a terminal untranslated sequence (69).
Figure 88:
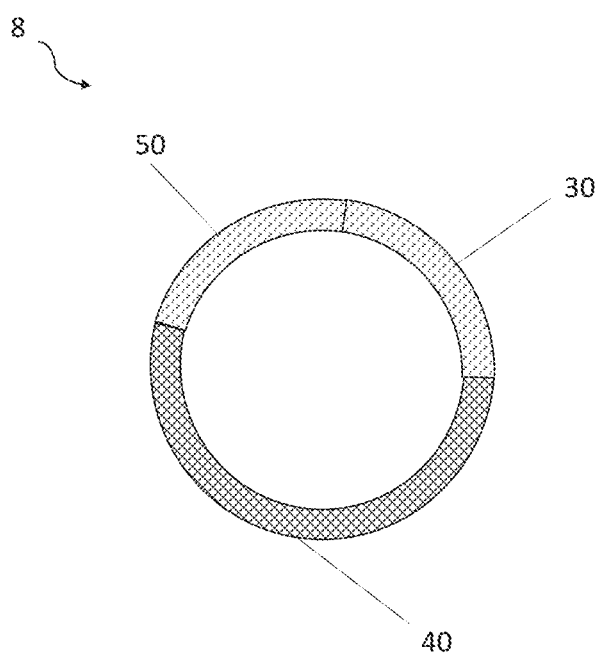
FIG. 88 illustrates the general circular RNA (8) structure formed post splicing. The circular RNA as depicted includes a 5' exon element (30), a core functional element (40) and a 3' exon element (50).
Figure 89A:
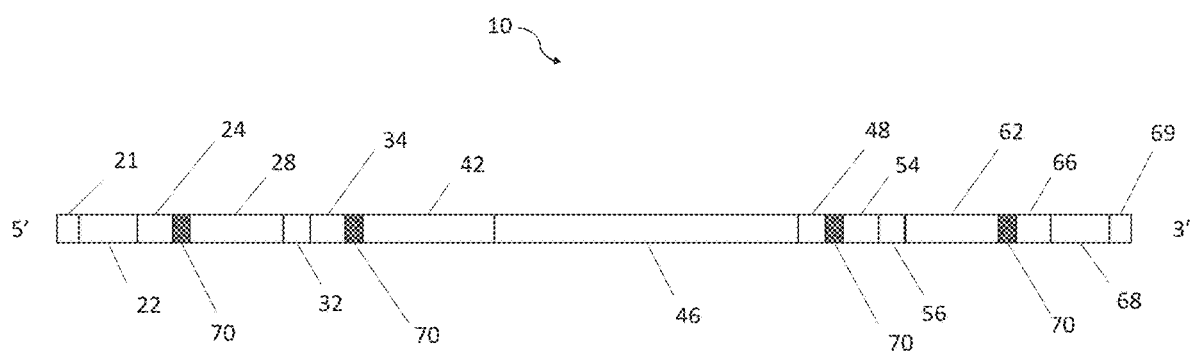
FIGS. 89A-89E illustrate the various ways an accessory element (70) (e.g., a miRNA binding site) may be included in a linear RNA polynucleotide.
Figure 89B:
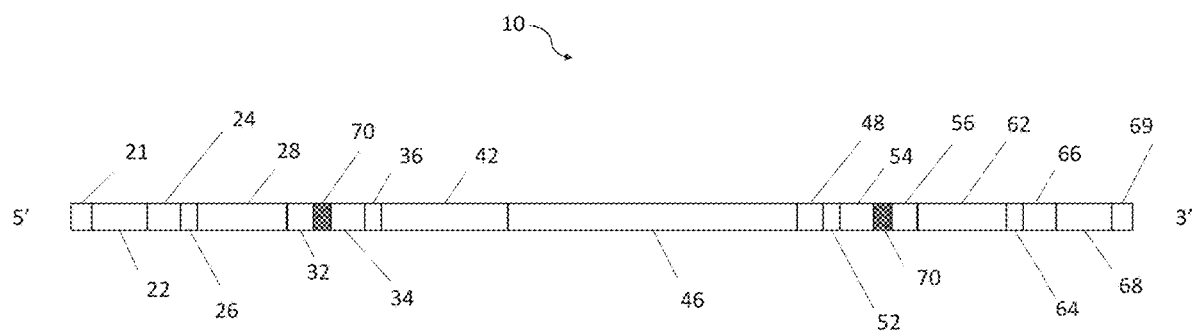
Figure 89C:
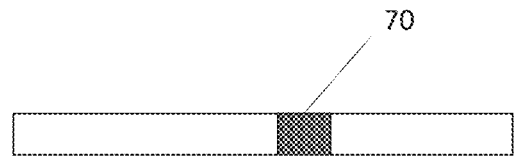
Figure 89D:
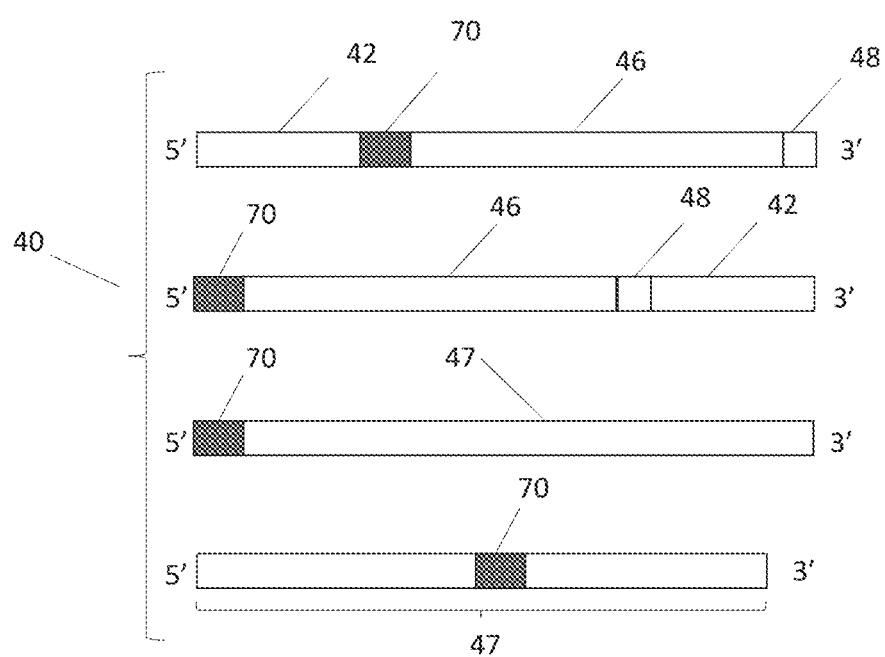
Figure 89E:
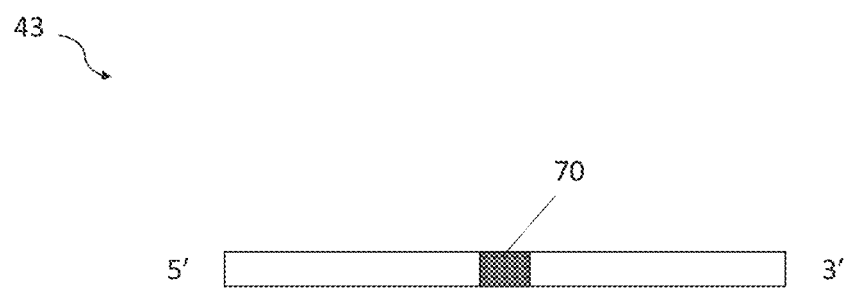

This example illustrates expression of SARS-CoV2 spike protein expression in vitro. Circular RNA encoding SARS-CoV2 stabilized spike protein was transfected into 293 cells using MessengerMax Transfection Reagent. 24 hours after transfection, the 293 cells were stained with a CR3022 anti-spike primary antibody and APC-labeled secondary antibody.

FIG. 73A shows circularization efficiency of roughly 4.5 kb SARS-Cov2 stabilized spike protein-encoding RNA resulting from an in vitro transcription reaction. FIG. 73B and FIG. 73C show SARS-CoV2 stabilized spike protein expression on 293 cells after the circular RNA transfection with MessengerMax Transfection Reagent relative to mock transfected cells.

FIG. 77A and FIG. 77B show SARS-CoV2 stabilized spike protein expression by percentage of cells and gMFI on 293 cells after transfection of a panel of circular RNAs, containing variable IRES sequences, codon optimized coding regions, and stabilized SARS-CoV2 spike proteins, using MessengerMax Transfection Reagent. FIG. 77C shows the relationship between MFI and percentage.

Example 76

This example shows in vivo cytokine response after IV injection of 0.2 mg/kg circRNA preparations encapsulated in a lipid nanoparticle formulation. circRNA splicing reactions synthesized with GTP as a precursor RNA initiator and splicing nucleotide incited greater cytokine responses than purified circRNA and linear m1ψ-mRNA due to the presence of triphosphorylated 5' termini in the splicing reaction. Levels of IL-10, IL-6, IL-10, IL-12p70, RANTES, TNFα were measured from blood drawn 6 hours following intravenous injection of the LNP-formulated circRNA preparation. Mice injected with PBS were used as a control.

As seen in FIG. 74, circRNA splicing reactions synthesized with GTP as a precursor RNA initiator and splicing nucleotide incite greater cytokine responses than purified circRNA and linear m1ψ-mRNA due to the presence of triphosphorylated 5' termini in the splicing reaction.

Example 77

This example illustrates intramuscular delivery of varying doses of lipid nanoparticle containing circular RNAs. Mice were dosed with either 0.1p g, 1 μg, or 10 μg of circRNA formulated in lipid nanoparticles. Whole body IVIS imagine was conducted at 6 hours following an injection of luciferin (FIG. 75A and FIG. 75B). Ex vivo IVIS imaging was conducted at 24-hour. Flux values for liver, quad, and calf are shown in FIG. 75C. FIG. 76B and FIG. 76C show that the expression of the circular RNA is present in the muscle tissue of the mice.

Example 78

This example illustrates expression of multiple circular RNAs in LNP formulations. Circular RNA constructs encoding either hEPO or fLuc were dosed in a single and mixed set of LNPs. hEPO concentration in the serum (FIG. 76A) and total flux by IVIS imaging (FIG. 76B) was determined. The results show that the circular RNA hEPO or fLuc constructs individually formulated or co-formulated expressed protein efficiently.

Example 79

Example 79A: Hepatocyte plating and culture

Primary human hepatocytes (PHH), primary mouse hepatocytes (PMH), primary cynomolgus monkey hepatocytes (PCH) were thawed and resuspended in hepatocyte thawing medium (Xenotech, cat #K8600/K8650) followed by centrifugation. The supernatant was discarded, and the pelleted cells were resuspended in hepatocyte plating medium (Xenotech, cat #K8200). Cells were counted via hemocytometer and plated on Bio-coat collagen-I coated 96-well plates at a density of 25,000 cells/well for PHH, 25,000 cells/well for PMH, and 50,000 cells/well for PCH in 100 uL of plating media. Plated cells were allowed to settle and adhere for 6 hours in a tissue culture incubator at 37° C. and 5% $CO_2$ atmosphere. After incubation cells were checked for monolayer formation after which the plating media was aspirated and replaced with 100 ul of culture media (Xenotech, cat #K8300). Media was replaced every 24 hours for the duration of the experiment.

Example 79B: In Vitro Screening of LNP Formulated Circular RNA Encoding Firefly Luciferase in Primary Human, Mouse, and Cynomolgus Monkey Hepatocytes A circular RNA construct comprising a TIE and a coding element encoding for firefly luciferase was produced and transfected into LNPs. Various concentrations of LNPs formulated with the circularized RNA (oRNA) were diluted in hepatocyte media supplemented with 3% fetal bovine serum (FBS) (ThermoFisher, cat #A3160401). Media was aspirated from the cells prior to addition of 100 uL of LNP/FBS/media mixture to the cells.

Luciferase activity was detected in primary human (FIG. 90A), mouse (FIG. 90B), and cynomolgus monkey (FIG. 90C) hepatocyte. 24 hours post-transfection plates were removed from the incubator and allowed to equilibrate to room temperature for 15 mins. A volume of 100 μL of Firefly Luciferase one-step glow assay working solution (Pierce, cat #16196) was added to each well. The plate was placed on a microplate shaker (ThermoFisher, cat #S72050) and mixed at 300 rpm for 3 min. Post-mixing, the plate was allowed to incubate at room temperature for 10 min. Luminescence was read using a Varioskan or Bio-Tek Cytation5 instrument.

Figure 90A:
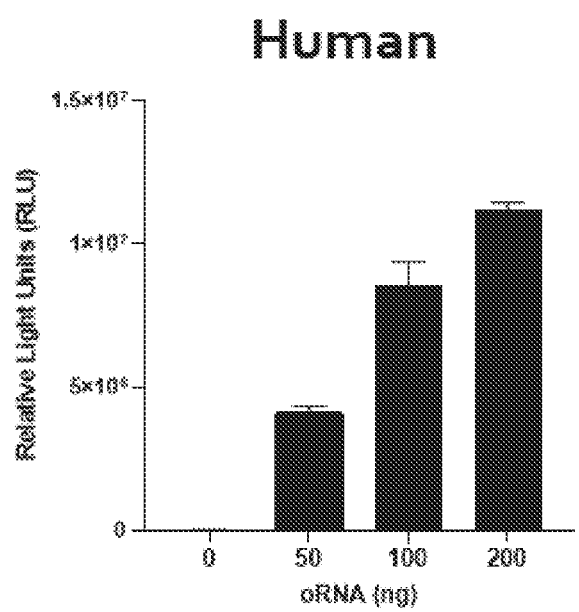
FIGS. 90A-90C illustrate a screening of a LNP formulated with circular RNA encoding firefly luciferase and having a TIE in primary human (FIG. 90A), mouse (FIG. 90B), and cynomolgus monkey (FIG. 90C) hepatocyte with varying dosages in vitro.
Figure 90B:
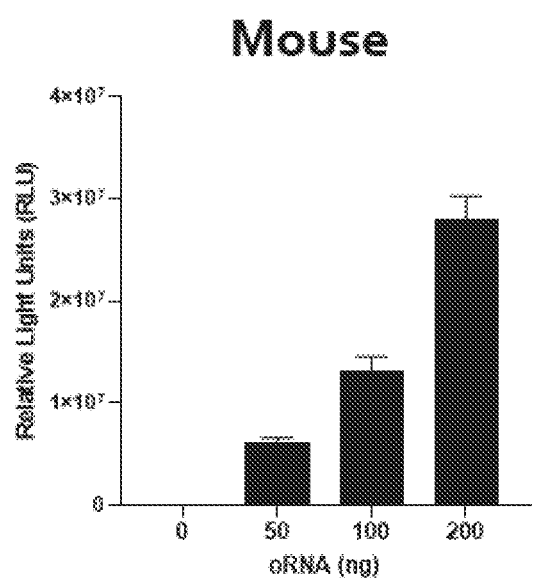
Figure 90C:
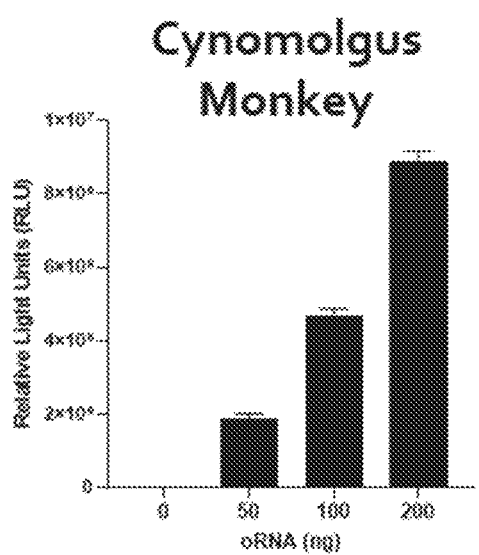

As seen in FIG. 90A, FIG. 90B, and FIG. 90C, TIE containing circular RNAs are capable of driving firefly luciferase protein expression in primary hepatocytes from multiple species in a dose-dependent manner when transfected in vitro with an LNP.

Example 79C: In Vitro Screening of LNP Formulated Circular RNA Encoding Firefly Luciferase in Multiple Primary Human Hepatocyte Donors A circular RNA construct comprising a TIE and a coding element encoding for firefly luciferase was produced and transfected into LNPs. Various concentrations of LNPs formulated with the circularized RNA (oRNA) were diluted in hepatocyte media supplemented with 3% fetal bovine serum (FBS) (ThermoFisher, cat #A3160401). Media was aspirated from the cells prior to addition of 100 ul of LNP/FBS/media mixture to the cells.

Luciferase activity was detected in primary human (FIG. 91A), mouse (FIG. 91B), and cynomolgus monkey (FIG. 91C) hepatocyte. 24 hours post-transfection plates were removed from the incubator and allowed to equilibrate to room temperature for 15 mins. A volume of 100 μL of Firefly Luciferase one-step glow assay working solution (Pierce, cat #16196) was added to each well. The plate was placed on a microplate shaker (ThermoFisher, cat #S72050) and mixed at 300 rpm for 3 min. Post-mixing, the plate was allowed to incubate at room temperature for 10 min. Luminescence was read using a Varioskan or Bio-Tek Cytation5 instrument.

Figure 91A:
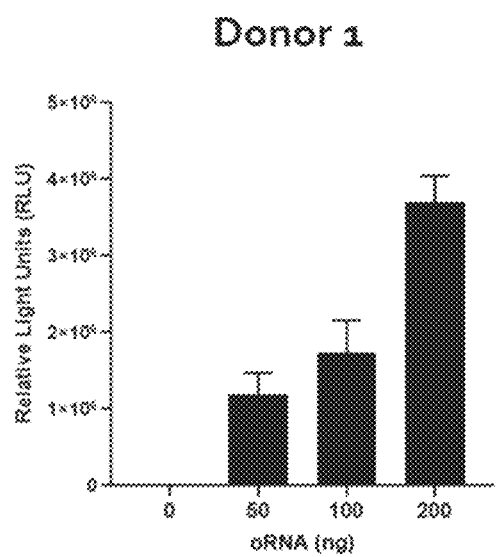
FIGS. 91A-91C illustrate a screening of a LNP formulated with circular RNA encoding firefly luciferase and having a TIE, in primary human hepatocyte from three different donors (Donor 1—FIG. 91A; Donor 2—FIG. 91B; and Donor 3—FIG. 91C) with varying dosages in vitro.
Figure 91B:
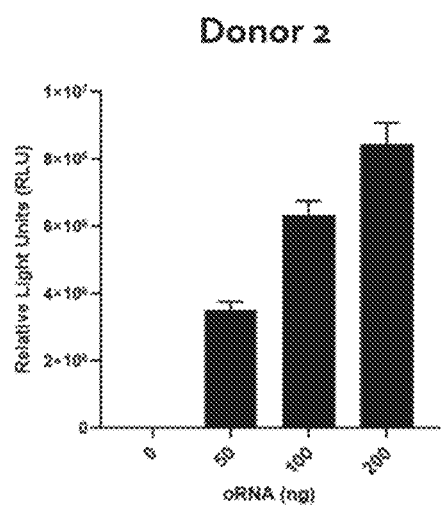
Figure 91C:
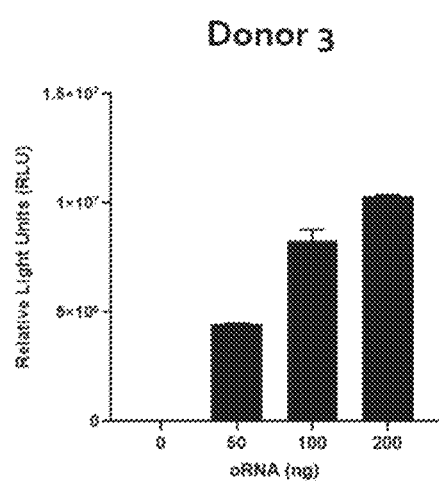

As seen in FIG. 91A, FIG. 91B, and FIG. 91C, TIE containing circular RNAs are capable of driving firefly luciferase protein expression in primary hepatocytes from multiple human donors in a dose-dependent manner when transfected in vitro with an LNP.

Example 80

In Vitro Expression of LNP Formulated with Circular RNA Encoding for GFP in Multiple Human Cell Models.

A circular RNA construct was produced comprising a TIE and coding element encoding for a GFP protein. LNP were formulated with the circular RNA construct. Then various concentrations of the LNP containing the circular RNA construct were diluted in hepatocyte media supplemented with 3% fetal bovine (FBS) (ThermoFisher, cat #A3160401). Media was aspirated from the cells prior to addition of 100 ul of LNP/FBS/media mixture to the cells.

HeLa (human cervical adenocarcinoma; ATCC, cat #CCL-2), HEK293 (human embryonic kidney; ATCC, cat #CRL-1573), and HUH7 (human liver hepatocellular carcinoma; JCRB, cat #JCRB0403) were transfected as previously described with LNP formulated oRNAs. Twenty-four hours post-transfection, the media was removed and the cells were trypsinized. The trypsinized cells were neutralized with PBS supplemented with 10% FBS, harvested, and transferred to a tube. The tube was centrifuged to pellet the cells and the supernatant was aspirated. The pellet was stored at −80° C. prior to lysis. For lysis the cells were thawed on ice and were lysed with 100 L/well RIPA buffer (Boston Bio Products, Cat. BP-115) plus freshly added 1 mM DTT, and 250 U/mL Benzonase (EMD Millipore, cat #71206-3), and protease inhibitor mixture consisting of complete protease inhibitor cocktail (Sigma, cat #11697498001). Cells were kept on ice for 30 minutes at which time NaCl (1M final concentration) was added. Cell lysates were thoroughly mixed and retained on ice for 30 min. The whole cell extracts (WCE) were centrifuged to pellet debris. A Bradford assay (Bio-Rad, cat #500-0001)

was used to assess protein content of the lysates. The Bradford assay procedure was completed according to the manufacturer's protocol. Extracts were stored at −20° C. prior to use. Western blots were performed to assess GFP protein levels. Whole cell extract lysates were mixed with Laemmli buffer and denatured at 95° C. for 10 min. Western blots were run using the NuPage system on 4-12% Bis-Tris gels (ThermoFisher, cat #NPO335BOX) according to the manufacturer's protocol followed by wet transfer onto 0.45 m nitrocellulose membrane (ThermoFisher, cat #LC2001). After transfer membranes were rinsed thoroughly with water and stained with Ponceau S solution (Boston Bio Products, cat #ST-180) to confirm complete and even transfer. Blots were blocked using 5% Dry Milk in TBS for 30 minutes on a lab rocker at room temperature. Blots were rinsed with 1×TBST (Boston BioProducts, cat #IBB-180) and probed with mouse dylight 680-tagged anti-GFP monoclonal antibody (ThermoFisher, cat #MA515256D680) at 1:1,000 in 1×TBST. Anti-3-actin or GAPDH was used as a loading control (ThermoFisher, cat #AM4302/AM4300) at 1:4,000 in 1×TBST and incubated simultaneously with the GFP primary antibody. Blots were sealed in a bag and kept overnight at 4° C. on a lab rocker. After incubation, blots were rinsed 3 times for 5 minutes each in 1×TBST and probed with mouse secondary antibodies (ThermoFisher, cat #PI35519) at 1:25,000 each in 1×TBST for 30 minutes at room temperature. After incubation, blots were rinsed 3 times for 5 minutes each in 1×TBST. Blots were visualized and analyzed using a Licor Odyssey system.

Figure 92:
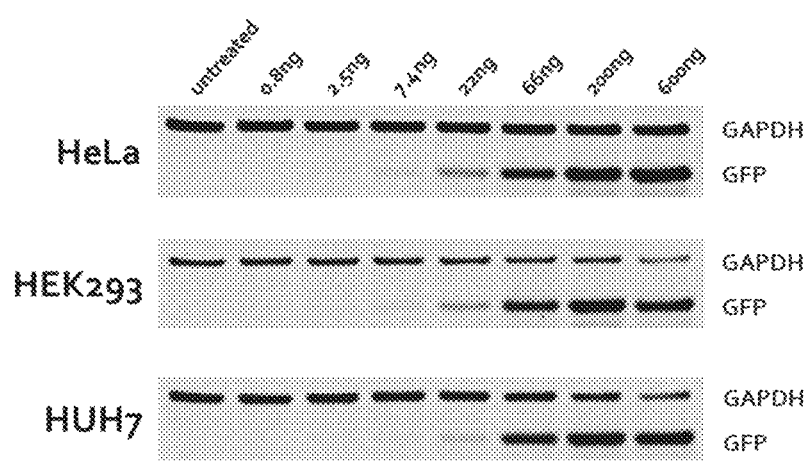
FIG. 92 illustrates in vitro expression of LNP formulated with circular RNA encoding for GFP and having a TIE, in HeLa, HEK293, and HUH7 human cell models.

As shown in FIG. 92, TIE-containing circular RNA is capable of expressing GFP protein in diverse human cell lines (e.g., HeLa, HEK293, and HUH7 cells) in a dose dependent manner when transfected in vitro with an LNP.

Example 81

In Vitro Expression of LNP Formulated with Circular RNA Encoding for GFP in Primary Human Hepatocytes.

A circular RNA construct was produced comprising a TIE and coding element encoding for a GFP protein. Various concentrations of LNP containing circularized RNA (oRNA) were diluted in hepatocyte media supplemented with 3% fetal bovine serum (FBS) (ThermoFisher, cat #A3160401). Media was aspirated from the cells prior to addition of 100 µL of LNP/FBS/media mixture to the cells.

Primary human hepatocytes (PHH) were thawed and resuspended in hepatocyte thawing medium (Xenotech, cat #K8600/K8650) followed by centrifugation. The supernatant was discarded, and the pelleted cells were resuspended in hepatocyte plating medium (Xenotech, cat #K8200). Cells were counted via hemocytometer and plated on Bio-coat collagen-I coated 96-well plates at a density of 25,000 cells/well for PHH, 25,000 cells/well for PMH, and 50,000 cells/well for PCH in 100 ul of plating media. Plated cells were allowed to settle and adhere for 6 hours in a tissue culture incubator at 37° C. and 5% $CO_2$ atmosphere. After incubation cells were checked for monolayer formation after which the plating media was aspirated and replaced with 100 ul of culture media (Xenotech, cat #K8300). Media was replaced every 24 hours for the duration of the experiment.

Primary human hepatocytes were transfected as previously described with LNP formulated oRNAs. Twenty-four hours post-transfection, the media was removed and the cells were trypsinized. The trypsinized cells were neutralized with PBS supplemented with 10% FBS, harvested, and transferred to a tube. The tube was centrifuged to pellet the cells and the supernatant was aspirated. The pellet was stored at −80° C. prior to lysis. For lysis the cells were thawed on ice and were lysed with 100 L/well RIPA buffer (Boston Bio Products, Cat. BP-115) plus freshly added 1 mM DTT, and 250 U/ml Benzonase (EMD Millipore, cat #71206-3), and protease inhibitor mixture consisting of complete protease inhibitor cocktail (Sigma, cat #11697498001). Cells were kept on ice for 30 minutes at which time NaCl (1M final concentration) was added. Cell lysates were thoroughly mixed and retained on ice for 30 min. The whole cell extracts (WCE) were centrifuged to pellet debris. A Bradford assay (Bio-Rad, cat #500-0001) was used to assess protein content of the lysates. The Bradford assay procedure was completed according to the manufacturer's protocol. Extracts were stored at −20° C. prior to use. Western blots were performed to assess GFP protein levels. Whole cell extract lysates were mixed with Laemmli buffer and denatured at 95° C. for 10 min. Western blots were run using the NuPage system on 4-12% Bis-Tris gels (ThermoFisher, cat #NPO335BOX) according to the manufacturer's protocol followed by wet transfer onto 0.45 m nitrocellulose membrane (ThermoFisher, cat #LC2001). After transfer membranes were rinsed thoroughly with water and stained with Ponceau S solution (Boston Bio Products, cat #ST-180) to confirm complete and even transfer. Blots were blocked using 5% Dry Milk in TBS for 30 minutes on a lab rocker at room temperature. Blots were rinsed with 1×TBST (Boston BioProducts, cat #IBB-180) and probed with mouse dylight 680-tagged anti-GFP monoclonal antibody (ThermoFisher, cat #MA515256D680) at 1:1,000 in 1×TBST. Anti-3-actin or GAPDH was used as a loading control (ThermoFisher, cat #AM4302/AM4300) at 1:4,000 in 1×TBST and incubated simultaneously with the GFP primary antibody. Blots were sealed in a bag and kept overnight at 4° C. on a lab rocker. After incubation, blots were rinsed 3 times for 5 minutes each in 1×TBST and probed with mouse secondary antibodies (ThermoFisher, cat #PI35519) at 1:25,000 each in 1×TBST for 30 minutes at room temperature. After incubation, blots were rinsed 3 times for 5 minutes each in 1×TBST. Blots were visualized and analyzed using a Licor Odyssey system.

Figure 93:
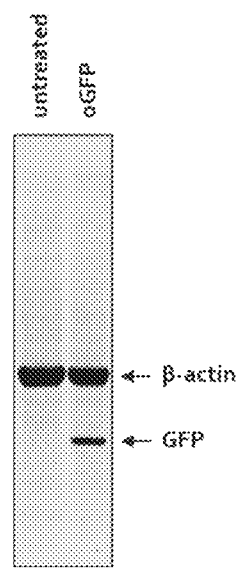
FIG. 93 illustrates in vitro expression of LNP formulated with circular RNAs encoding a GFO protein and having a TIE, in primary human hepatocytes.

As shown in the western blot in FIG. 93, circular RNAs containing a TIE is capable of successfully encoding a GFP protein in primary human hepatocytes when transfected in vivo with an LNP.

Example 82

In Vitro Expression of Firefly Luciferase in Circular RNA Encoding Firefly Luciferase in Mouse Myoblast and Primary Human Skeletal Muscle Myoblast Cells Using Lipofectamine.

A circular RNA construct comprising a TIE and coding element encoding firefly luciferase protein.

Primary human skeletal muscle (HSkM) cells (Lonza, cat #20TL356514) were thawed in a 37° C. water bath and plated at recommended seeding density (3,000 to 5,000 per $cm^2$) in SkGM-2 BulletKit growth media (Lonza, cat #CC-3245) and allowed to grow overnight. Cells were detached using ReagentPack subculture reagents (Lonza, cat #CC-5034) and plated on tissue culture grade 96-well plates at recommended seeding density and allowed to grow overnight in a tissue culture incubator at 37° C. and 5% $CO_2$ atmosphere or to 70-80% confluency with growth media changed every 2 days.

For one 96-well plate reaction, 0.3 µL of Lipofectamine-3000 transfection reagent (Lipo3K) (ThermoFisher, cat #L3000015) was mixed with 5 µL Opti-MEM reduced serum media (ThermoFisher, cat #51985091). In a separate tube, per reaction, firefly luciferase (f.luc) oRNA (at 10-200 ng) was combined with 5 µL Opti-MEM and 0.2 µL P3000TM enhancer reagent (ThermoFisher, cat #L3000015). Equal volumes of Lipo3K/Opti-MEM mix was combined with oRNA/Opti-MEM mix and incubated at room temperature for 15 min. The Lipo3K/oRNA mixture was added to each well to be transfected and placed in a tissue culture incubator at 37° C. and 5% $CO_2$ atmosphere for 24 hours.

After 24 hours, the transfection plates were removed from the incubator and allowed to equilibrate to room temperature for 15 minutes. A volume of 100 µL of firefly luciferase one-step glow assay working solution (Pierce, cat #16196) was added to each well. The plate was placed on a microplate shaker (ThermoFisher, cat #S72050) and mixed at 300 rpm for 3 minutes. Post-mixing, the plate was allowed to incubate at room temperature for 10 minutes. Luminescence was read using a Varioskan or Bio-Tek Cytation5 instrument.

Figure 94A:
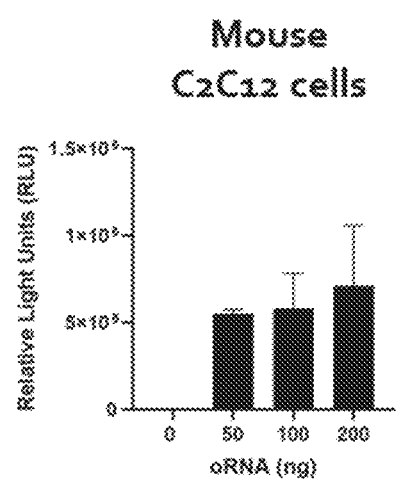
FIGS. 94A and 94B illustrate in vitro expression of circular RNA encoding firefly luciferase and having a TIE, in mouse myoblast (FIG. 94A) and primary human muscle myoblast (FIG. 94B) cells.
Figure 94B:
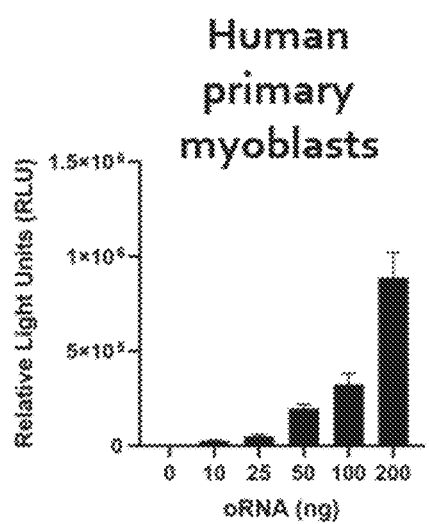

As shown in FIG. 94A and FIG. 94B, circular RNAs comprising a TIE is capable of driving firefly luciferase protein expression in myoblasts from different species in a dose-dependent manner when transfected in vitro with lipofectamine.

Example 83

In Vitro Expression of Firefly Luciferase in Circular RNA Encoding Firefly Luciferase in Differentiated Primary Human Skeletal Muscles Myotubes A circular RNA construct comprising a TIE and coding element encoding firefly luciferase protein.

Primary human skeletal muscle (HSkM) cells (Lonza, cat #20TL356514) were thawed in a 37° C. water bath and plated at recommended seeding density (3,000 to 5,000 per $cm^2$) in SkGM-2 BulletKit growth media (Lonza, cat #CC-3245) and allowed to grow overnight. Cells were detached using ReagentPack subculture reagents (Lonza, cat #CC-5034) and plated on tissue culture grade 96-well plates at recommended seeding density and allowed to grow overnight in a tissue culture incubator at 37° C. and 5% $CO_2$ atmosphere or to 70-80% confluency with growth media changed every 2 days. Once cells reached 70-80% confluency, growth media was removed, cells were washed twice in 1×PBS (Gibco, cat #10010023) and changed to differentiation media consisting of F-10 (1×) (Gibco, cat #11550-043) supplemented with 2% Horse Serum (Gibco, cat #26050088) and 1% Pen-Strep (Gibco, cat #15140-122). Media was changed daily for 5 to 6 days until nearly all myoblasts had fused to form myotubes.

For one 96-well plate reaction, 0.3 µL of Lipofectamine-3000 transfection reagent (Lipo3K) (ThermoFisher, cat #L3000015) was mixed with 5ul Opti-MEM reduced serum media (ThermoFisher, cat #51985091). In a separate tube, per reaction, firefly luciferase (f.luc) oRNA (at 10-200 ng) was combined with 5 µL Opti-MEM and 0.2 µL P3000TM enhancer reagent (ThermoFisher, cat #L3000015). Equal volumes of Lipo3K/Opti-MEM mix was combined with oRNA/Opti-MEM mix and incubated at room temperature for 15 min. The Lipo3K/oRNA mixture was added to each well to be transfected and placed in a tissue culture incubator at 37° C. and 5% $CO_2$ atmosphere for 24 hours.

After 24 hours, transfection plates were removed from the incubator and allowed to equilibrate to room temperature for 15 minutes. A volume of 100 µL of Firefly Luc one-step glow assay working solution (Pierce, cat #16196) was added to each well. The plate was placed on a microplate shaker (ThermoFisher, cat #S72050) and mixed at 300 rpm for 3 minutes. Post-mixing, the plate was allowed to incubate at room temperature for 10 minutes. Luminescence was read using a Varioskan or Bio-Tek Cytation5 instrument.

Figure 95A:
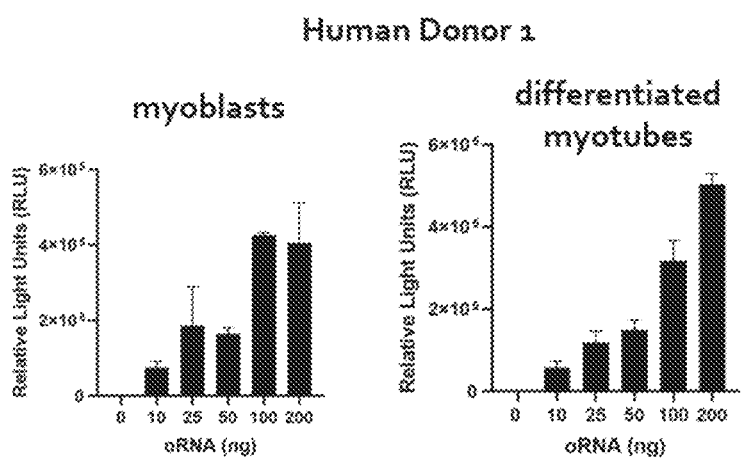
FIGS. 95A and 95B illustrate in vitro expression of circular RNA encoding for firefly luciferase and having a TIE, in myoblasts and differentiated primary human skeletal muscle myotubes.
Figure 95B:
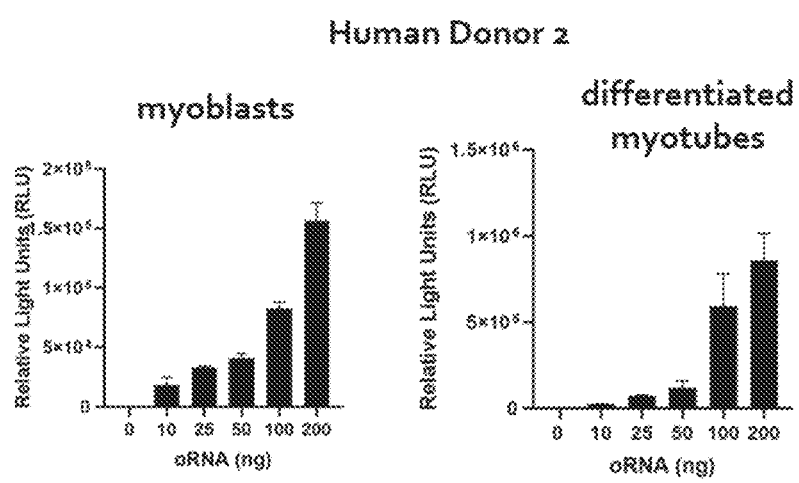

As shown in FIG. 95A and FIG. 95B, a circular RNA comprising a TIE is capable of driving firefly luciferase protein expression in primary muscles cells through differentiated states (e.g., in myoblast and differentiated myotubes) in multiple human donors in a dose-dependent manner when transfected in vitro with lipofectamine.

Example 83

Cell-Free In Vitro Translation of Circular RNAs Containing TIEs

A cell-free rabbit reticulocyte in vitro translation assay (Promega, cat #L4540) was completed to characterize protein products from various RNA templates. Both linear mRNA and circular oRNA templates were used in the assay and reaction components were assembled according to the manufacturer's protocol. Prior to assay, RNA templates were denatured at 65° C. for 3 minutes and immediately cooled on ice. All reaction components were assembled on ice. Flexi Rabbit Reticulocyte kit components, complete amino acid mixture (Promega, cat #L5061), RNAsin TIEuclease inhibitor (Promega, cat #N2111), and transcend tRNA (Promega, cat #L5061) were added to denatured RNA templates. The reaction was vortexed to mix and incubated at 30° C. for 60 minutes and then placed on ice.

The reaction mixture was added to 1× sample buffer (ThermoFisher, cat #NP0007) and heated at 70° C. for 15 minutes. The denatured protein sample was loaded onto 4-12% Bis-Tris gels (ThermoFisher, cat #NPO335BOX). Gel electrophoresis was completed, and the gel was wet transferred onto 0.45 m nitrocellulose membrane (ThermoFisher, cat #LC2001). Post-transfer, the membrane was blocked for 1 hour with rocking in freshly made TBS with 0.5% Tween-20 (Boston Bioproducts Inc Cat #IBB-180). The membrane was incubated for 45 min with rocking with streptavidin-AP (Promega, cat #V5591) at a 1:2,500 dilution. The membrane was rinsed with four cycles of: twice with TBST and twice with deionized water for 1 min per rinse. The membrane was incubated with Western Blue substrate (Promega, cat #S3841) for 45 minutes and the membrane was rinsed in water and scanned on a LICOR Odyssey CLx imaging system.

Figure 96A:
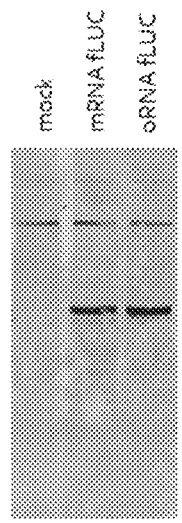
FIGS. 96A and 96B illustrate cell-free in vitro translation of circular RNA of variable sizes.
Figure 96B:
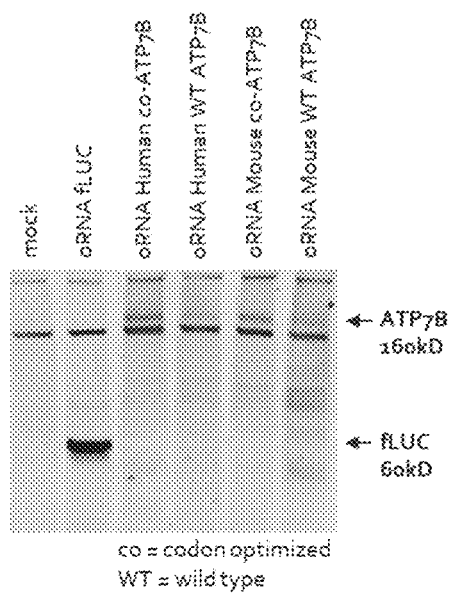

As shown in FIG. 96A and FIG. 96B, a circular RNA comprising a TIE is capable of driving protein expression in a cell-free lysate, independent of any cell type. FIG. 96A illustrates expression of firefly luciferase from a linear or circular RNA input. FIG. 96B illustrates expression of human and mouse ATP7B proteins with different codon optimization (co) approaches compared to wild-type native sequence (WT). The codon optimized-circular RNAs expressing ARP7B protein and the circular RNA expressing firefly luciferase shoed protein full-length protein expression.

Example 84

TIE Selection Methodology

Putative TIEs were identified for activity assessment from sequences in GenBank. Briefly, Riboviria and Unclassified Virus sequences greater than 1 kb in length were identified. 5' and intergenic UTRs were extracted based on putative CDS start and end sites with a minimum length cutoff of 250 nt. Reverse sequences were also collected for negative sense CDS annotations. For genuses not expected to contain TIE sequences, a few noncoding regions per genus were selected at random. Duplicates, >10 nt repeat-containing sequences, sequences with both XbaI and BamHI sites, and low-quality sequences (non acgt) were culled, then sequences were clustered through CDHit with an 80% sequence similarity cutoff for clustering; representative sequences from each cluster were selected for further study. For unclassified sequences or sequences expected to contain a TIE, all 5' and intergenic UTRs were selected; duplicates, >10 nt repeat-containing sequences, sequences with both XbaI and BamHI sites, and low-quality sequences (non acgt) were culled, then sequences were clustered through CDHit with a 95% (low risk, known IRESs) sequence similarity cutoff for clustering; representative sequences from each cluster were selected for further study. For both strategies, sequences shorter than 300 nt or unable to be synthesized due to sequence complexity were eliminated.

Example 85

Example 85A: TIE Activity in Primary Human T Cells

Nucleic acid sequences containing putative TIEs were inserted into a circular RNA (oRNA) construct prior to the start codon of a *gaussia* luciferase reporter sequence. oRNA containing the TIE was synthesized and purified. Purified oRNA was formulated into lipid nanoparticles. LNP-oRNA was transfected into T cells in vitro. Supernatant was harvested and replaced 24 and 48 hours after transfection, and *gaussia* luciferase expression from oRNA was determined using a coelenterazine-containing detection reagent and luminometer. Higher luminescence at 24 hours indicates higher TIE function. Higher luminescence at 48 hours relative to 24 hours indicates higher oRNA stability due to TIE function.

Example 85B: TIE Activity in Primary Human Hepatocytes

Nucleic acid sequences containing putative TIEs were inserted into a circular RNA (oRNA) construct prior to the start codon of a *gaussia* luciferase reporter sequence. oRNA containing the TIE was synthesized and purified. Purified oRNA was formulated into lipid nanoparticles. LNP-oRNA was transfected into hepatocytes in vitro. Supernatant was harvested and replaced 24 and 48 hours after transfection, and *gaussia* luciferase expression from oRNA was determined using a coelenterazine-containing detection reagent and luminometer. Higher luminescence at 24 hours indicates higher TIE function. Higher luminescence at 48 hours relative to 24 hours indicates higher oRNA stability due to TIE function.

Example 85C: TIE Activity in Primary Human Myotubes

Nucleic acid sequences containing putative TIEs were inserted into a circular RNA (oRNA) construct prior to the start codon of a *gaussia* luciferase reporter sequence. oRNA containing the TIE was synthesized and purified. Purified oRNA was formulated into lipid nanoparticles. LNP-oRNA was transfected into human myotubes in vitro. Supernatant was harvested and replaced 24 and 48 hours after transfection, and *gaussia* luciferase expression from oRNA was determined using a coelenterazine-containing detection reagent and luminometer. Higher luminescence at 24 hours indicates higher TIE function. Higher luminescence at 48 hours relative to 24 hours indicates higher oRNA stability due to TIE function.

Example 86

TIE Tissue Tropism

Select TIE-containing oRNAs were formulated into LNPs. LNP-oRNAs were transfected into T cells, hepatocytes, and myotubes. Supernatant was harvested and replaced 24 and 48 hours after transfection, and *gaussia* luciferase expression from oRNA was determined using a coelenterazine-containing detection reagent and luminometer. Higher luminescence at 24 hours indicates higher TIE function. Higher luminescence at 48 hours relative to 24 hours may indicate higher oRNA stability due to TIE function. TIE activity was compared between cell types and differences resulting from TIE tissue preference were noted. Differences may be a result of the TIE engaging proteins that show tissue-specific expression and promoting enhanced translation initiation, degradation, or stability.

Example 86

Example 86A: TIE Deletion Scanning

Select TIE sequences with progressive deletions from either the 5' end or 3' end of the TIE were inserted into a circular RNA (oRNA) construct prior to the start codon of a *gaussia* luciferase reporter sequence. oRNA containing the TIE variant was synthesized and purified. Purified oRNA was formulated into lipid nanoparticles. LNP-oRNA was transfected into human primary T cells. Supernatant was harvested and replaced 24 and 48 hours after transfection, and *gaussia* luciferase expression from oRNA was determined using a coelenterazine-containing detection reagent and luminometer. Higher luminescence at 24 hours indicates higher TIE function. Higher luminescence at 48 hours relative to 24 hours may indicate higher oRNA stability due to TIE function. Expression or stability impairment due to progressive deletions identifies the core functional unit of the TIE.

Example 86B: TIE Variant Generation and Identification

Select TIE-containing oRNA synthesis plasmids were subjected to error-prone PCR to introduce random mutations into the PCR product. PCR product was used as a template for oRNA synthesis. Purified oRNA was formulated into LNPs and transfected into primary human T cells. Polysome fractions were harvested from T cells at 6, 24, 48, and 72 hours post-transfection by HPLC. RNA associated with each polysome fraction was extracted from polysome fractions and sequenced by NGS. TIE mutation enrichment in each polysome fraction at each time point was analyzed to identify mutations that 1) maintain or improve translation activity from the TIE and/or 2) improve stability of the oRNA.

Example 86C: TIE Single and Multi-Variant Validation

Nucleic acid sequences containing putative beneficial TIE mutations from example 6 alone or in combination were inserted into a circular RNA (oRNA) construct prior to the start codon of a *gaussia* luciferase reporter sequence. oRNA containing the TIE variant was synthesized and purified. Purified oRNA was formulated into lipid nanoparticles. LNP-oRNA was transfected into human primary T cells. Supernatant was harvested and replaced 24 and 48 hours after transfection, and *gaussia* luciferase expression from oRNA was determined using a coelenterazine-containing detection reagent and luminometer. Higher luminescence at 24 hours indicates higher TIE function. Higher luminescence at 48 hours relative to 24 hours indicates higher oRNA stability due to TIE function.

Example 87

Example 87A: Selection of Eukaryotic TIEs

Selection of eukaryotic TIEs. Putative eukaryotic TIEs were identified using several databases. TIEs selected include sequences 40-1578 nucleotides in length and may or may not contain identified modification (m6A) sites.

Example 87B: TIEs Containing Modified Nucleotides (m6A)

Nucleic acid sequences containing putative TIEs were inserted into a circular RNA (oRNA) construct preceding the coding region of a *gaussia* luciferase reporter sequence. oRNAs were synthesized with a titration of modified nucleotide. Purified oRNA was formulated into lipid nanoparticles. LNP-oRNAs were transfected into T cells, hepatocytes, and myotubes. Supernatant was harvested and replaced 24 and 48 hours after transfection, and *gaussia* luciferase expression from oRNA was determined using a coelenterazine-containing detection reagent and luminometer. Higher luminescence of modified nucleotide containing TIEs at 24 hours indicates necessity for modification for enhanced function. Higher luminescence at 48 hours relative to 24 hours indicates modified nucleotide containing TIEs enhance stability of oRNA.

Example 88

Expression of TIEs in Cells Undergoing Oxidative and/or Hypoxic Stress

Nucleic acid sequences containing putative TIEs were inserted into a circular RNA (oRNA) construct preceding the coding region of a *gaussia* luciferase reporter sequence. Purified oRNA was formulated into lipid nanoparticles. Hepatocytes were treated with hydrogen peroxide to induce oxidative stress or $CoCl_2$ to induce hypoxic stress. LNP-oRNA was transfected into hepatocytes (under hypoxic stress, oxidative stress, or untreated) in vitro. Supernatant was harvested and replaced 24 and 48 hours after transfection, and *gaussia* luciferase expression from oRNA was determined using a coelenterazine-containing detection reagent and luminometer. Higher luminescence at 24 hours indicates higher TIE function. Higher luminescence at 48 hours relative to 24 hours may indicate higher oRNA stability due to TIE function.

Example 89

Aptamer as a TIE
Nucleic acid sequences containing aptamers against translation initiation factors (ie eIF4E, eIF4G, eIF4a) were inserted into a circular RNA (oRNA) construct preceding the coding region of a *gaussia* luciferase reporter sequence. Purified oRNA was formulated into lipid nanoparticles. LNP-oRNAs were transfected into hepatocytes. Supernatant was harvested and replaced 24 and 48 hours after transfection, and *gaussia* luciferase expression from oRNA was determined using a coelenterazine-containing detection reagent and luminometer. Higher luminescence at 24 hours indicates higher TIE function. Higher luminescence at 48 hours relative to 24 hours may indicate higher oRNA stability due to TIE function.

Example 90

Tandem TIEs
Select combinations of viral, eukaryotic, and/or aptamer TIEs were inserted into a circular RNA (oRNA) construct preceding the coding region of a *gaussia* luciferase reporter sequence. oRNAs were synthesized with a titration of modified nucleotide. Purified oRNA was formulated into lipid nanoparticles. LNP-oRNAs were transfected into T cells, hepatocytes, and myotubes. Supernatant was harvested and replaced 24 and 48 hours after transfection, and *gaussia* luciferase expression from oRNA was determined using a coelenterazine-containing detection reagent and luminometer. Higher luminescence of constructs containing multiple TIEs at 24 hours indicates a synergy of TIEs. Higher luminescence at 48 hours relative to 24 hours may indicate having multiple TIEs in one construct enhance stability of oRNA.

Example 91

Example 91A: Coding Aptamers to Enhance Cap-Independent Translation

Certain aptamers that bind to eIF4E, eIF4a, and other translation initiators are known to inhibit translation by forcing the proteins to adopt a non-functional conformation. Nucleic acid sequences containing aptamers against translation initiation factors (ie eIF4E, eIF4a) were inserted into a circular RNA (oRNA) construct preceding a functional TIE and the coding region of a *gaussia* luciferase reporter sequence. Purified oRNA was formulated into lipid nanoparticles. LNP-oRNAs were transfected into hepatocytes. Supernatant was harvested and replaced 24 and 48 hours after transfection, and *gaussia* luciferase expression from oRNA was determined using a coelenterazine-containing detection reagent and luminometer. Higher luminescence at 24 hours indicates a preference for cap-independent translation. Higher luminescence at 48 hours relative to 24 hours indicates higher oRNA stability due to inhibition of cap-dependent translation.

Example 91B: Coding Aptamers to Enhance Cap-Independent Translation

Cotransfection of oRNA and aptamers. Certain aptamers that bind to eIF4E, eIF4a, and other translation initiators are known to inhibit translation by forcing the proteins to adopt a non-functional conformation. Nucleic acid sequences containing aptamers against translation initiation factors (ie eIF4E, eIF4a) were co-transfected with a circular RNA (oRNA) containing a TIE and the coding region of a *gaussia* luciferase reporter. Purified aptamer and oRNA were formulated into lipid nanoparticles together. LNP-oRNAs were transfected into hepatocytes. Supernatant was harvested and replaced 24 and 48 hours after transfection, and *gaussia* luciferase expression from oRNA was determined using a coelenterazine-containing detection reagent and luminometer. Higher luminescence at 24 hours indicates a preference for cap-independent translation. Higher luminescence at 48 hours relative to 24 hours may indicate higher oRNA stability due to inhibition of cap-dependent translation.

Example 92

Figure 101A:
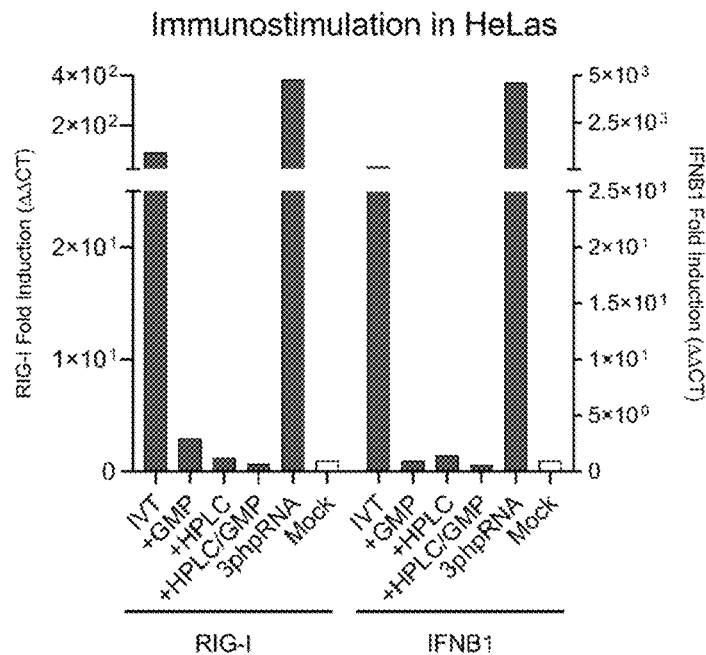
FIG. 101A and FIG. 101B show induction of RIG-1 and IFNB1 RNA expression, markers of immune stimulation, following transfection of the cells with the various RNA preparations indicated. All RNA preparations except for the commercially available 3phpRNA were produced using in vitro transcription and circularization of RNA comprising an *Anabaena* permuted intron, GLuc reading frame, strong homology arms, 5' and 3' spacers, and a CVB3 IRES. RIG-1 and IFNB1 RNA expression was measured using RT-qPCR.
Figure 101B:
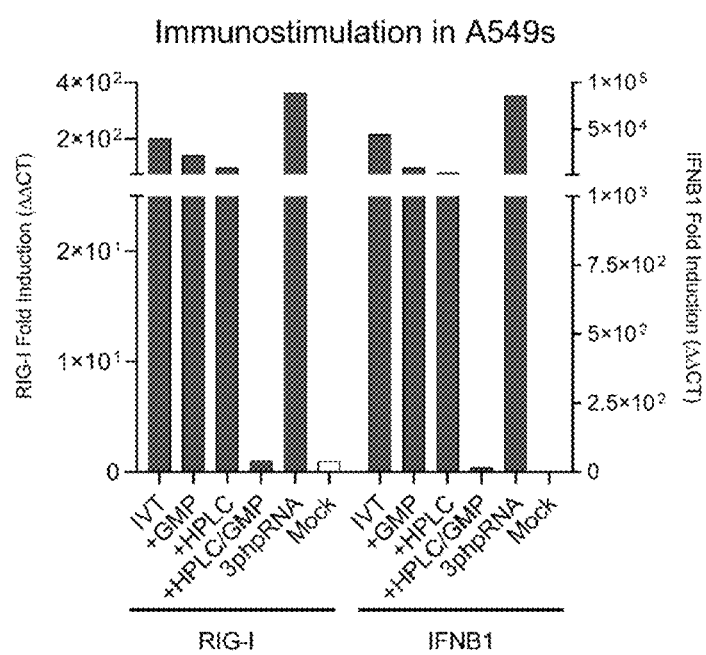

Immunogenicity of circular RNAs was assessed. Induction of RIG-1 and IFNB1 RNA expressions, markers of immune stimulation, was measured using RT-cPCR following transfection of the cells with various RNA preparations. All RNA preparations except for the commercially available 3phpRNA were produced using in vitro transcription (IVT) and circularization of RNA comprising an *Anabaena* permuted intron, GLuc reading frame, strong homology arms, 5' and 3' spacers, and a CVB3 IRES. In both HeLa cells (FIG. 101A) and A594 cells (FIG. 101B), the highest levels of RIG-1 and IFNB1 were induced by the IVT reaction product prepared in the absence of excess GMP and by the positive control 3phpRNA.

Example 93

IRES Selection and Screening

Roughly 3,000 potential internal ribosome entry site (IRES) sequence candidates were computationally identified from viral untranslated regions in partial and complete viral sequence available in the art (e.g., Genbank). Each DNA template was cloned to include of the IRES sequences from Table_A_IRES. Exemplary constructs included a 5' enhanced intron element, a 5' enhanced exon element, a punitive IRES, a coding element encoding *Gaussia* Luciferase, a 3' enhanced exon element, and a 3' enhanced intron element. Engineered circular RNA (oRNA) was generated from the DNA template by in vitro transcription (IVT); and oRNA was subsequently purified from non-circular RNA components of the IVT reaction.

Purified oRNA was nanoprecipitated with lipids to form LNP-oRNA constructs. LNPs were formulated first by creating empty lipid nanoparticles using a Precision Nanosystems Ignite instrument with a "NextGen" mixing chamber. Ethanol phase contained Lipid 39 from Table 10b, DSPC, cholesterol, and DMG-PEG 2000 (Avanti Polar Lipids, Inc., Alabaster, AL) at a molar ratio of 45:9:44:2 was combined with 50 mM sodium acetate buffer at pH 4.5. A 3:1 aqueous to ethanol mixing ratio was used. The empty LNPs were then dialyzed in 1 L of 1×PBS and exchanged 2 times over 18 hours. Dialyzed empty LNPs were then mixed with a final circular RNA concentration of 40 ug/mL in 50 mM sodium acetate buffer at pH 4.5. A 3:1 aqueous to empty lipid nanoparticle mixing ratio was used. The LNPs final ionizable lipid to RNA phosphate ratio was at 6.0.

Primary human skeletal myotubes, primary human hepatocytes, and activated primary human T cells were treated with formulated LNP-oRNA in triplicate. Protein expression in supernatant was assessed by luminescence measurements 48 hours following transfection. Table 27 provides the protein expression and stability measurements for the screening. Measured numbers are normalized to a control (caprine kobuvirus IRES) and represented as a fold change.

(SEQ ID NO: 3777)
Control (caprine kobuvirus IRES)

-continued
gtggccacgcccgggccaccgatacttcccttcactcctt cgggactgttggggaggaacacaacagggctcccctgttt tcccattccttccccctttccaaccccaaccgccgtat ctggtggcggcaagacacacgggtctttccctctaaagca caattgtgtgtgtgtcccaggtcctcctgcgtacggtgcg ggagtgctcccacccaactgttgtaagcctgtccaacgcg tcgtcctggcaagactatgacgtcgcatgttccgctgcgg atgccgaccgggtaaccggttccccagtgtgtgtagtgcg atcttccaggtcctcctggttggcgttgtccagaaactgc ttcaggtaagtggggtgtgcccaatccctacaaaggttga ttctttcaccaccttaggaatgctccggaggtaccccagc aacagctgggatctgaccggaggctaattgtctacgggtg gtgtttccttttcttttcacacaactctactgcGTacaa ctcactgactatccacttgctctgTcacG

TABLE 27

Expression and functional stability screening of IRES

| SEQ ID NO | [Mod] Fold Change Myo | [Mod] T Fold Change | [Mod] PHH Fold Change |
|---|---|---|---|
| 97 | 0.260167 | 0.353177 | 1.163467 |
| 98 | 0.290648 | 0.677026 | 0.78802 |
| 99 | 0.163908 | 0.27666 | 1.020326 |
| 100 | 0.495163 | 0.48261 | 1.22777 |
| 101 | 0.533025 | 0.852995 | 1.370347 |
| 102 | 0.044695 | 0.030995 | 0.514093 |
| 103 | 0.045577 | 0.039508 | 0.647085 |
| 104 | 0.076071 | 0.168841 | 0.774536 |
| 105 | 0.249558 | 0.329006 | 0.642043 |
| 106 | 0.352419 | 0.648041 | 1.09325 |
| 107 | 0.287896 | 0.937122 | 1.119079 |
| 109 | 0.249157 | 0.626121 | 0.853308 |
| 110 | 0.242425 | 0.513277 | 0.717483 |
| 111 | 0.222321 | 0.465065 | 0.786969 |
| 112 | 0.371086 | 0.636962 | 0.807476 |
| 113 | 0.317071 | 0.43731 | 0.827882 |
| 114 | 0.05835 | 0.068124 | 0.789812 |
| 115 | 0.050735 | 0.046932 | 0.425032 |
| 116 | 0.039211 | 0.030739 | 0.529925 |
| 117 | 0.042734 | 0.046123 | 0.425775 |
| 118 | 0.154586 | 0.456184 | 0.666903 |
| 119 | 0.198021 | 0.987593 | 0.62119 |
| 120 | 0.275525 | 0.701885 | 0.489288 |
| 121 | 0.627572 | 1.028933 | 0.997696 |
| 122 | 0.388602 | 0.8876 | 0.832163 |
| 123 | 0.039714 | 0.030111 | 0.638047 |
| 125 | 0.382696 | 0.641754 | 0.649185 |
| 126 | 0.057929 | 0.06647 | 0.645602 |
| 127 | 0.293568 | 0.685807 | 0.674465 |
| 128 | 0.489317 | 0.583675 | 1.021214 |
| 129 | 0.053695 | 0.089454 | 0.668895 |
| 130 | 0.040577 | 0.060757 | 0.572842 |
| 131 | 0.039511 | 0.033359 | 0.53476 |
| 132 | 0.039977 | 0.031182 | 0.564324 |
| 133 | 0.039326 | 0.030041 | 0.541046 |
| 134 | 0.046625 | 0.052943 | 0.46727 |
| 136 | 0.047864 | 0.042316 | 0.428555 |
| 138 | 0.372287 | 0.637832 | 0.615651 |
| 139 | 0.059696 | 0.097316 | 0.520599 |
| 140 | 0.16008 | 0.399455 | 0.715372 |
| 141 | 0.040253 | 0.031062 | 0.546956 |
| 142 | 0.038521 | 0.027425 | 0.46798 |

TABLE 27-continued

Expression and functional stability screening of IRES

| SEQ ID NO | [Mod] Fold Change Myo | [Mod] T Fold Change | [Mod] PHH Fold Change |
|---|---|---|---|
| 143 | 0.03901 | 0.032654 | 0.420921 |
| 145 | 0.03927 | 0.026297 | 0.635934 |
| 146 | 0.043229 | 0.034645 | 0.587329 |
| 147 | 0.042637 | 0.036624 | 0.559359 |
| 148 | 0.039126 | 0.029094 | 0.736827 |
| 149 | 0.039186 | 0.028926 | 0.711791 |
| 150 | 0.03864 | 0.027048 | 0.514678 |
| 151 | 0.037309 | 0.026948 | 0.493258 |
| 152 | 0.038449 | 0.026258 | 0.615534 |
| 153 | 0.038341 | 0.025876 | 0.695107 |
| 154 | 0.0402 | 0.0304 | 0.722679 |
| 155 | 0.038723 | 0.027351 | 0.586864 |
| 156 | 0.038511 | 0.027142 | 0.627475 |
| 157 | 0.039049 | 0.027127 | 0.731503 |
| 158 | 0.038048 | 0.027701 | 0.672155 |
| 159 | 0.038668 | 0.025816 | 0.61191 |
| 160 | 0.039335 | 0.026247 | 0.5674 |
| 161 | 0.038824 | 0.025876 | 0.492452 |
| 162 | 0.038216 | 0.023393 | 0.575165 |
| 163 | 0.038264 | 0.027191 | 0.52053 |
| 164 | 0.038197 | 0.026151 | 0.524974 |
| 165 | 0.037817 | 0.026532 | 0.561699 |
| 166 | 0.038844 | 0.026828 | 0.575901 |
| 167 | 0.038524 | 0.025708 | 0.69976 |
| 168 | 0.038788 | 0.025543 | 0.731934 |
| 169 | 0.039231 | 0.027338 | 0.432891 |
| 170 | 0.037986 | 0.022969 | 0.541642 |
| 171 | 0.038154 | 0.027212 | 0.582587 |
| 172 | 0.037112 | 0.026558 | 0.639476 |
| 173 | 0.037335 | 0.026078 | 0.504809 |
| 174 | 0.037049 | 0.025905 | 0.577144 |
| 175 | 0.037822 | 0.025498 | 0.530502 |
| 177 | 0.038266 | 0.026051 | 0.561219 |
| 178 | 0.039045 | 0.027092 | 0.500802 |
| 179 | 0.037153 | 0.026609 | 0.50571 |
| 180 | 0.038755 | 0.028951 | 0.487148 |
| 181 | 0.037539 | 0.025831 | 0.659122 |
| 182 | 0.03747 | 0.025334 | 0.496612 |
| 183 | 0.038763 | 0.025478 | 0.768879 |
| 184 | 0.043604 | 0.030907 | 0.689648 |
| 185 | 0.039562 | 0.027297 | 0.687583 |
| 186 | 0.039007 | 0.026413 | 0.665244 |
| 187 | 0.038049 | 0.026641 | 0.587503 |
| 188 | 0.037709 | 0.026875 | 0.671188 |
| 189 | 0.037762 | 0.027089 | 0.52406 |
| 190 | 0.03731 | 0.026211 | 0.418576 |
| 191 | 0.038235 | 0.02599 | 0.484504 |
| 192 | 0.039939 | 0.027233 | 0.483419 |
| 194 | 0.020192 | 0.00648 | 0.519074 |
| 195 | 0.019531 | 0.006334 | 0.376436 |
| 196 | 0.019542 | 0.00641 | 0.498646 |
| 197 | 0.019244 | 0.006324 | 0.402627 |
| 198 | 0.018573 | 0.006291 | 0.419065 |
| 199 | 0.019198 | 0.006785 | 0.34161 |
| 200 | 0.019364 | 0.00696 | 0.385662 |
| 201 | 0.020124 | 0.006802 | 0.336954 |
| 202 | 0.019957 | 0.006958 | 0.433697 |
| 203 | 0.019453 | 0.006298 | 0.462718 |
| 204 | 0.019494 | 0.006471 | 0.441202 |
| 205 | 0.019442 | 0.006373 | 0.629439 |
| 206 | 0.018867 | 0.006885 | 0.374898 |
| 207 | 0.01914 | 0.006134 | 0.460931 |
| 208 | 0.018981 | 0.006092 | 0.433478 |
| 209 | 0.019624 | 0.006283 | 0.410556 |
| 210 | 0.019591 | 0.007049 | 0.588881 |
| 211 | 0.019397 | 0.006595 | 0.542165 |
| 212 | 0.019568 | 0.00626 | 0.532913 |
| 213 | 0.018989 | 0.006333 | 0.547859 |
| 214 | 0.01915 | 0.006268 | 0.425401 |
| 216 | 0.019187 | 0.006268 | 0.524257 |
| 217 | 0.019397 | 0.006238 | 0.390937 |
| 218 | 0.019339 | 0.006206 | 0.494667 |
| 219 | 0.018624 | 0.00708 | 0.490922 |
| 220 | 0.019181 | 0.006335 | 0.474431 |
| 221 | 0.019256 | 0.006244 | 0.457017 |
| 222 | 0.019112 | 0.006315 | 0.449704 |
| 223 | 0.01928 | 0.006732 | 0.413984 |
| 224 | 0.019162 | 0.006106 | 0.445024 |
| 225 | 0.019165 | 0.006185 | 0.408971 |
| 226 | 0.018975 | 0.006285 | 0.510492 |
| 227 | 0.019522 | 0.007133 | 0.437234 |
| 228 | 0.019859 | 0.006494 | 0.570592 |
| 229 | 0.019454 | 0.006315 | 0.473748 |
| 230 | 0.018871 | 0.006278 | 0.51804 |
| 231 | 0.019655 | 0.006844 | 0.511603 |
| 232 | 0.019285 | 0.006225 | 0.565024 |
| 233 | 0.019316 | 0.006211 | 0.442953 |
| 235 | 0.019002 | 0.007102 | 0.395003 |
| 236 | 0.018841 | 0.006315 | 0.509341 |
| 237 | 0.019316 | 0.006327 | 0.318761 |
| 238 | 0.019395 | 0.007836 | 0.596039 |
| 239 | 0.019249 | 0.006356 | 0.413194 |
| 241 | 0.019155 | 0.006661 | 0.275657 |
| 242 | 0.019203 | 0.006108 | 0.443553 |
| 243 | 0.019402 | 0.006124 | 0.451916 |
| 244 | 0.018854 | 0.007129 | 0.467265 |
| 245 | 0.019175 | 0.006401 | 0.543468 |
| 246 | 0.019056 | 0.007055 | 0.4824 |
| 247 | 0.018824 | 0.006353 | 0.484173 |
| 248 | 0.019655 | 0.006175 | 0.368398 |
| 249 | 0.01946 | 0.006185 | 0.396805 |
| 250 | 0.019 | 0.006117 | 0.480145 |
| 252 | 0.01904 | 0.007513 | 0.39182 |
| 253 | 0.018899 | 0.006977 | 0.575079 |
| 254 | 0.019338 | 0.006347 | 0.526008 |
| 255 | 0.019193 | 0.006255 | 0.287479 |
| 256 | 0.019022 | 0.006292 | 0.433444 |
| 257 | 0.01915 | 0.006647 | 0.428502 |
| 258 | 0.019567 | 0.006018 | 0.468423 |
| 259 | 0.019534 | 0.006067 | 0.58953 |
| 260 | 0.019436 | 0.007053 | 0.357243 |
| 261 | 0.019714 | 0.006449 | 0.480901 |
| 262 | 0.018951 | 0.006418 | 0.40858 |
| 263 | 0.019192 | 0.006212 | 0.560046 |
| 264 | 0.019612 | 0.006356 | 0.552301 |
| 265 | 0.019321 | 0.006195 | 0.401567 |
| 266 | 0.019369 | 0.006648 | 0.604516 |
| 267 | 0.019151 | 0.006684 | 0.464703 |
| 268 | 0.018286 | 0.007032 | 0.4753 |
| 269 | 0.01937 | 0.006374 | 0.5176 |
| 270 | 0.019261 | 0.006259 | 0.499406 |
| 271 | 0.019395 | 0.00619 | 0.412264 |
| 272 | 0.018911 | 0.006199 | 0.421016 |
| 274 | 0.019303 | 0.006349 | 0.455375 |
| 276 | 0.019357 | 0.006325 | 0.376791 |
| 278 | 0.019529 | 0.006257 | 0.583499 |
| 279 | 0.019217 | 0.006392 | 0.4111 |
| 281 | 0.019185 | 0.006136 | 0.587463 |
| 282 | 0.019681 | 0.006236 | 0.688522 |
| 283 | 0.020003 | 0.006456 | 0.361814 |
| 284 | 0.021001 | 0.008113 | 0.463016 |
| 285 | 0.019166 | 0.006828 | 0.350735 |
| 286 | 0.019521 | 0.006951 | 0.480012 |
| 287 | 0.019513 | 0.006754 | 0.469042 |
| 288 | 0.018469 | 0.006294 | 0.484396 |
| 289 | 0.019434 | 0.006129 | 0.551443 |
| 290 | 0.019277 | 0.006906 | 0.508385 |
| 291 | 0.021833 | 0.009489 | 0.384556 |
| 293 | 0.01252 | 0.006427 | 0.356902 |
| 294 | 0.011884 | 0.006276 | 0.322886 |
| 295 | 0.012392 | 0.00627 | 0.447166 |
| 297 | 0.012283 | 0.00621 | 0.567064 |
| 298 | 0.012177 | 0.006287 | 0.464133 |
| 299 | 0.012284 | 0.006151 | 0.348391 |
| 300 | 0.012339 | 0.006071 | 0.502548 |
| 301 | 0.012495 | 0.007116 | 0.35649 |

TABLE 27-continued

Expression and functional stability screening of IRES

| SEQ ID NO | [Mod] Fold Change Myo | [Mod] T Fold Change | [Mod] PHH Fold Change |
|---|---|---|---|
| 302 | 0.01222 | 0.006362 | 0.411845 |
| 303 | 0.012195 | 0.006278 | 0.26423 |
| 304 | 0.012215 | 0.006262 | 0.552091 |
| 305 | 0.01249 | 0.006788 | 0.42767 |
| 306 | 0.012402 | 0.006165 | 0.371097 |
| 307 | 0.012281 | 0.006139 | 0.520864 |
| 308 | 0.012497 | 0.00617 | 0.397038 |
| 309 | 0.012793 | 0.006274 | 0.245538 |
| 310 | 0.012404 | 0.006334 | 0.348876 |
| 311 | 0.012122 | 0.006441 | 0.294773 |
| 312 | 0.012249 | 0.006229 | 0.325353 |
| 313 | 0.012563 | 0.006174 | 0.365834 |
| 314 | 0.012287 | 0.006596 | 0.462958 |
| 315 | 0.012275 | 0.006142 | 0.298952 |
| 316 | 0.012716 | 0.007565 | 0.34122 |
| 317 | 0.012291 | 0.006397 | 0.309566 |
| 318 | 0.012115 | 0.006393 | 0.329808 |
| 319 | 0.01227 | 0.008317 | 0.304387 |
| 320 | 0.012221 | 0.006647 | 0.328903 |
| 321 | 0.012186 | 0.007163 | 0.399922 |
| 322 | 0.015035 | 0.031123 | 0.376798 |
| 323 | 0.012308 | 0.006096 | 0.237291 |
| 324 | 0.01192 | 0.006316 | 0.405807 |
| 325 | 0.012466 | 0.00625 | 0.493302 |
| 328 | 0.012498 | 0.00643 | 0.514255 |
| 329 | 0.012432 | 0.006216 | 0.374611 |
| 330 | 0.012053 | 0.006128 | 0.420442 |
| 331 | 0.012416 | 0.006082 | 0.375976 |
| 332 | 0.01236 | 0.006301 | 0.525602 |
| 333 | 0.012418 | 0.006263 | 0.410027 |
| 334 | 0.011605 | 0.006186 | 0.411457 |
| 335 | 0.011728 | 0.006232 | 0.357123 |
| 336 | 0.012106 | 0.006323 | 0.380811 |
| 337 | 0.012118 | 0.006278 | 0.325981 |
| 338 | 0.012218 | 0.006206 | 0.377091 |
| 339 | 0.012209 | 0.006258 | 0.32511 |
| 340 | 0.012372 | 0.006041 | 0.380202 |
| 341 | 0.012382 | 0.00629 | 0.480572 |
| 342 | 0.011896 | 0.006308 | 0.348783 |
| 343 | 0.01204 | 0.006332 | 0.37449 |
| 344 | 0.011928 | 0.006417 | 0.471347 |
| 345 | 0.01169 | 0.006267 | 0.36332 |
| 346 | 0.012345 | 0.006259 | 0.366717 |
| 347 | 0.012182 | 0.006163 | 0.363674 |
| 348 | 0.012163 | 0.00616 | 0.444482 |
| 349 | 0.012659 | 0.006222 | 0.317343 |
| 350 | 0.01182 | 0.006202 | 0.590775 |
| 351 | 0.011972 | 0.006135 | 0.408389 |
| 352 | 0.011885 | 0.006384 | 0.34904 |
| 353 | 0.011969 | 0.006398 | 0.336116 |
| 354 | 0.012428 | 0.006564 | 0.404646 |
| 355 | 0.012092 | 0.006308 | 0.299465 |
| 356 | 0.012409 | 0.006126 | 0.356694 |
| 357 | 0.012519 | 0.006278 | 0.390957 |
| 358 | 0.011963 | 0.006349 | 0.303741 |
| 359 | 0.012077 | 0.006261 | 0.334388 |
| 360 | 0.012007 | 0.006365 | 0.350437 |
| 361 | 0.012282 | 0.007154 | 0.317387 |
| 362 | 0.012469 | 0.007445 | 0.472965 |
| 363 | 0.012436 | 0.006211 | 0.393245 |
| 364 | 0.012106 | 0.006298 | 0.499986 |
| 365 | 0.012805 | 0.009062 | 0.426256 |
| 366 | 0.01212 | 0.006302 | 0.373071 |
| 367 | 0.01206 | 0.006217 | 0.396929 |
| 368 | 0.011994 | 0.006227 | 0.438247 |
| 369 | 0.011901 | 0.006318 | 0.340287 |
| 370 | 0.012341 | 0.007446 | 0.356303 |
| 371 | 0.012601 | 0.006237 | 0.447917 |
| 372 | 0.012511 | 0.007461 | 0.304352 |
| 373 | 0.012419 | 0.006273 | 0.445464 |
| 374 | 0.012212 | 0.006298 | 0.325297 |
| 375 | 0.012262 | 0.006342 | 0.253124 |
| 376 | 0.01206 | 0.00625 | 0.506673 |
| 377 | 0.012314 | 0.006239 | 0.391603 |
| 378 | 0.011869 | 0.006468 | 0.357757 |
| 380 | 0.013014 | 0.007118 | 0.33064 |
| 381 | 0.014152 | 0.007984 | 0.444288 |
| 382 | 0.012422 | 0.006289 | 0.366077 |
| 383 | 0.012649 | 0.0065 | 0.360518 |
| 384 | 0.012302 | 0.006376 | 0.350175 |
| 385 | 0.012345 | 0.006215 | 0.391858 |
| 386 | 0.012388 | 0.006074 | 0.51586 |
| 387 | 0.012519 | 0.007024 | 0.397167 |
| 388 | 0.013891 | 0.00748 | 0.425872 |
| 391 | 0.00426 | 0.025652 | 1.07762 |
| 392 | 0.004221 | 0.024819 | 0.967405 |
| 393 | 0.004402 | 0.026185 | 1.490273 |
| 395 | 0.004363 | 0.024306 | 1.116184 |
| 396 | 0.004078 | 0.025204 | 1.218613 |
| 397 | 0.004141 | 0.025195 | 1.186671 |
| 399 | 0.004058 | 0.025739 | 1.164329 |
| 400 | 0.004405 | 0.026216 | 0.849372 |
| 401 | 0.004166 | 0.025629 | 1.02162 |
| 402 | 0.004116 | 0.025377 | 1.037716 |
| 403 | 0.004734 | 0.028736 | 1.197272 |
| 404 | 0.004247 | 0.025532 | 0.859999 |
| 405 | 0.004301 | 0.025699 | 0.866291 |
| 406 | 0.004319 | 0.025744 | 1.453868 |
| 407 | 0.00439 | 0.026383 | 0.93497 |
| 408 | 0.00535 | 0.032252 | 0.865951 |
| 409 | 0.004149 | 0.025932 | 0.961605 |
| 410 | 0.004251 | 0.025634 | 1.117515 |
| 411 | 0.004339 | 0.025073 | 1.08764 |
| 412 | 0.004524 | 0.025372 | 0.873893 |
| 413 | 0.004216 | 0.025102 | 1.007087 |
| 414 | 0.004159 | 0.025802 | 0.964101 |
| 415 | 0.004389 | 0.025762 | 0.882981 |
| 416 | 0.004232 | 0.024642 | 1.018017 |
| 417 | 0.004211 | 0.025603 | 0.850283 |
| 418 | 0.004341 | 0.025106 | 0.846304 |
| 419 | 0.004202 | 0.024844 | 1.080883 |
| 420 | 0.004135 | 0.024946 | 0.97078 |
| 422 | 0.004459 | 0.025873 | 1.058666 |
| 423 | 0.004274 | 0.025787 | 1.226844 |
| 424 | 0.004383 | 0.024211 | 0.850711 |
| 425 | 0.004319 | 0.025464 | 0.973357 |
| 426 | 0.004226 | 0.025422 | 0.838836 |
| 427 | 0.004226 | 0.025762 | 0.973639 |
| 428 | 0.004161 | 0.025186 | 0.86052 |
| 429 | 0.004196 | 0.02512 | 1.028343 |
| 430 | 0.004215 | 0.0256 | 1.062937 |
| 431 | 0.00421 | 0.025733 | 1.00445 |
| 433 | 0.004741 | 0.027408 | 0.950117 |
| 434 | 0.004318 | 0.025754 | 1.092758 |
| 435 | 0.004428 | 0.025757 | 1.018609 |
| 436 | 0.004163 | 0.02512 | 0.727576 |
| 437 | 0.004243 | 0.025229 | 0.780294 |
| 438 | 0.00418 | 0.026218 | 1.039505 |
| 439 | 0.004887 | 0.026537 | 1.117939 |
| 440 | 0.005189 | 0.028072 | 0.889784 |
| 441 | 0.004272 | 0.025361 | 0.836717 |
| 442 | 0.004524 | 0.02738 | 0.921425 |
| 443 | 0.004218 | 0.025148 | 1.162762 |
| 444 | 0.004237 | 0.024847 | 0.728786 |
| 445 | 0.004293 | 0.025134 | 1.175772 |
| 446 | 0.005773 | 0.02595 | 0.999823 |
| 447 | 0.004274 | 0.025853 | 1.006288 |
| 448 | 0.004344 | 0.02546 | 0.863958 |
| 449 | 0.004346 | 0.025705 | 0.920647 |
| 450 | 0.004326 | 0.025476 | 0.816123 |
| 451 | 0.004237 | 0.025069 | 0.846299 |
| 452 | 0.005257 | 0.025596 | 0.800487 |
| 453 | 0.007428 | 0.026513 | 1.037012 |
| 454 | 0.004303 | 0.024553 | 0.94302 |
| 455 | 0.010434 | 0.037939 | 0.690676 |
| 456 | 0.007299 | 0.027948 | 1.099247 |

TABLE 27-continued

Expression and functional stability screening of IRES

| SEQ ID NO | [Mod] Fold Change Myo | [Mod] T Fold Change | [Mod] PHH Fold Change |
|---|---|---|---|
| 457 | 0.004251 | 0.025526 | 0.872239 |
| 458 | 0.004302 | 0.025162 | 1.050254 |
| 459 | 0.004217 | 0.025242 | 0.856808 |
| 460 | 0.004174 | 0.02491 | 0.771856 |
| 461 | 0.004283 | 0.023773 | 0.825394 |
| 462 | 0.004232 | 0.026042 | 1.06574 |
| 463 | 0.00424 | 0.02602 | 0.834992 |
| 464 | 0.004112 | 0.026109 | 1.215674 |
| 465 | 0.004229 | 0.025226 | 0.796978 |
| 466 | 0.004197 | 0.024889 | 1.287377 |
| 467 | 0.005177 | 0.025637 | 0.884542 |
| 469 | 0.00431 | 0.025306 | 1.013611 |
| 470 | 0.004249 | 0.025992 | 0.811355 |
| 471 | 0.004548 | 0.027775 | 0.99103 |
| 473 | 0.005266 | 0.027614 | 0.841048 |
| 474 | 0.005181 | 0.025263 | 1.045863 |
| 475 | 0.004214 | 0.024591 | 1.055417 |
| 476 | 0.004585 | 0.024957 | 0.96854 |
| 477 | 0.005587 | 0.026272 | 1.177024 |
| 478 | 0.005441 | 0.028445 | 0.988752 |
| 479 | 0.004717 | 0.027028 | 0.856542 |
| 480 | 0.004527 | 0.026333 | 0.732261 |
| 481 | 0.004189 | 0.026134 | 1.042274 |
| 482 | 0.004308 | 0.025592 | 1.144538 |
| 483 | 0.004232 | 0.025486 | 0.988084 |
| 484 | 0.005422 | 0.026264 | 0.930135 |
| 486 | 0.010488 | 0.036814 | 0.400608 |
| 487 | 0.009352 | 0.035227 | 0.398473 |
| 488 | 0.011628 | 0.039565 | 0.371609 |
| 489 | 0.010104 | 0.036386 | 0.522603 |
| 490 | 0.010243 | 0.035054 | 0.428049 |
| 491 | 0.009427 | 0.034974 | 0.456625 |
| 492 | 0.009978 | 0.034961 | 0.578826 |
| 493 | 0.017268 | 0.035854 | 0.439093 |
| 494 | 0.011939 | 0.036741 | 0.564414 |
| 495 | 0.009874 | 0.035139 | 0.393693 |
| 496 | 0.009436 | 0.033925 | 0.438625 |
| 499 | 0.017365 | 0.040412 | 0.408489 |
| 500 | 0.010443 | 0.035109 | 0.376297 |
| 501 | 0.098725 | 0.035501 | 0.705679 |
| 502 | 0.009362 | 0.036715 | 0.497175 |
| 503 | 0.010364 | 0.039033 | 0.408634 |
| 504 | 0.01097 | 0.034864 | 0.429402 |
| 505 | 0.011296 | 0.045354 | 0.444601 |
| 506 | 0.009332 | 0.034205 | 0.450232 |
| 507 | 0.009893 | 0.052264 | 0.571042 |
| 508 | 0.009472 | 0.034109 | 0.533749 |
| 510 | 0.010046 | 0.035326 | 0.405723 |
| 511 | 0.009439 | 0.03423 | 0.345853 |
| 512 | 0.009106 | 0.034492 | 0.364057 |
| 513 | 0.013017 | 0.036592 | 0.399432 |
| 514 | 0.029114 | 0.157091 | 0.665907 |
| 515 | 0.009588 | 0.035852 | 0.430589 |
| 516 | 0.01053 | 0.034159 | 0.347145 |
| 517 | 0.011616 | 0.049112 | 0.479119 |
| 518 | 0.010441 | 0.034833 | 0.526338 |
| 519 | 0.012705 | 0.03856 | 0.465362 |
| 520 | 0.036111 | 0.066426 | 0.601134 |
| 521 | 0.009721 | 0.035602 | 0.5263 |
| 522 | 0.009626 | 0.034174 | 0.411501 |
| 523 | 0.010243 | 0.034049 | 0.461773 |
| 524 | 0.009466 | 0.03404 | 0.450292 |
| 525 | 0.009484 | 0.035115 | 0.428652 |
| 526 | 0.034651 | 0.049443 | 0.470629 |
| 527 | 0.010225 | 0.035086 | 0.474979 |
| 528 | 0.01019 | 0.0345 | 0.559636 |
| 529 | 0.0097 | 0.044281 | 0.512486 |
| 531 | 0.011152 | 0.035546 | 0.358218 |
| 532 | 0.017782 | 0.037115 | 0.476891 |
| 533 | 0.010199 | 0.033963 | 0.420376 |
| 534 | 0.009483 | 0.035329 | 0.29936 |
| 535 | 0.90231 | 0.680855 | 0.881043 |
| 537 | 0.010176 | 0.034227 | 0.547417 |
| 539 | 0.009638 | 0.034846 | 0.4356 |
| 540 | 0.00967 | 0.035308 | 0.379571 |
| 541 | 0.020438 | 0.064563 | 0.553054 |
| 542 | 0.0096 | 0.035474 | 0.46663 |
| 543 | 0.010103 | 0.036928 | 0.391608 |
| 544 | 0.031817 | 0.071379 | 0.405136 |
| 545 | 0.011419 | 0.044632 | 0.471581 |
| 546 | 0.009434 | 0.034118 | 0.633882 |
| 547 | 0.009671 | 0.034574 | 0.37907 |
| 548 | 0.009753 | 0.03389 | 0.425888 |
| 549 | 0.009679 | 0.034543 | 0.416178 |
| 550 | 0.010414 | 0.035565 | 0.382037 |
| 551 | 0.009573 | 0.034555 | 0.569187 |
| 553 | 0.010895 | 0.037061 | 0.452852 |
| 554 | 0.0252 | 0.106556 | 0.399393 |
| 556 | 0.009499 | 0.034102 | 0.463958 |
| 557 | 0.016537 | 0.050391 | 0.406694 |
| 558 | 0.029851 | 0.098052 | 0.422865 |
| 559 | 0.240194 | 0.948046 | 0.755382 |
| 560 | 0.023732 | 0.142099 | 0.410883 |
| 561 | 0.009951 | 0.034656 | 0.525667 |
| 562 | 0.023838 | 0.071971 | 0.547672 |
| 563 | 0.029476 | 0.233222 | 0.518497 |
| 564 | 0.009775 | 0.033845 | 0.432675 |
| 565 | 0.014326 | 0.034722 | 0.462568 |
| 567 | 0.062129 | 0.223441 | 0.412738 |
| 568 | 0.010126 | 0.035292 | 0.406865 |
| 569 | 0.010231 | 0.035076 | 0.671012 |
| 570 | 0.010125 | 0.035003 | 0.480816 |
| 571 | 0.010039 | 0.034758 | 0.495482 |
| 572 | 0.010531 | 0.045745 | 0.522281 |
| 573 | 0.025354 | 0.034962 | 0.419466 |
| 574 | 0.243552 | 0.556199 | 0.762058 |
| 575 | 0.015572 | 0.035785 | 0.437496 |
| 576 | 0.013035 | 0.038805 | 0.531242 |
| 577 | 0.032586 | 0.079404 | 0.417157 |
| 578 | 0.02313 | 0.063316 | 0.474352 |
| 579 | 0.065246 | 0.302516 | 0.543815 |
| 581 | 0.354729 | 0.62217 | 1.144543 |
| 582 | 0.033618 | 0.058613 | 0.615124 |
| 583 | 0.308377 | 0.394948 | 0.932255 |
| 585 | 0.006337 | 0.020183 | 0.315108 |
| 586 | 0.163191 | 0.081969 | 0.381663 |
| 587 | 0.005108 | 0.023774 | 0.224587 |
| 588 | 0.021841 | 0.05963 | 0.370248 |
| 589 | 0.046721 | 0.333438 | 0.27475 |
| 590 | 0.090307 | 0.279891 | 0.29317 |
| 591 | 0.028787 | 0.07838 | 0.325743 |
| 592 | 0.005702 | 0.020121 | 0.306412 |
| 593 | 0.0099 | 0.046476 | 0.246072 |
| 594 | 0.015627 | 0.043937 | 0.215799 |
| 595 | 0.004629 | 0.019544 | 0.251833 |
| 596 | 0.046096 | 0.243097 | 0.24242 |
| 597 | 0.724998 | 0.981484 | 0.844379 |
| 598 | 0.026838 | 0.114469 | 0.289663 |
| 599 | 0.005828 | 0.019718 | 0.257416 |
| 600 | 0.005909 | 0.019865 | 0.251511 |
| 601 | 0.00614 | 0.020424 | 0.288905 |
| 602 | 0.005997 | 0.020776 | 0.216972 |
| 603 | 0.004669 | 0.019593 | 0.244223 |
| 604 | 0.008771 | 0.03346 | 0.323606 |
| 605 | 0.006624 | 0.020724 | 0.274329 |
| 606 | 0.005853 | 0.020382 | 0.242918 |
| 607 | 0.007747 | 0.021643 | 0.255363 |
| 608 | 0.005712 | 0.019678 | 0.221593 |
| 609 | 0.256073 | 0.504568 | 0.599603 |
| 610 | 0.005913 | 0.020199 | 0.199839 |
| 611 | 0.00447 | 0.019293 | 0.258074 |
| 612 | 0.005724 | 0.019734 | 0.360177 |
| 613 | 0.005694 | 0.019843 | 0.280102 |
| 614 | 0.005742 | 0.019885 | 0.286104 |
| 615 | 0.005705 | 0.019587 | 0.226829 |
| 616 | 0.006013 | 0.020573 | 0.266788 |

TABLE 27-continued

Expression and functional stability screening of IRES

| SEQ ID NO | [Mod] Fold Change Myo | [Mod] T Fold Change | [Mod] PHH Fold Change |
|---|---|---|---|
| 617 | 0.035272 | 0.094008 | 0.237734 |
| 618 | 0.026309 | 0.025971 | 0.242108 |
| 619 | 0.004687 | 0.020401 | 0.240359 |
| 620 | 0.00571 | 0.019825 | 0.218814 |
| 621 | 0.006001 | 0.020668 | 0.280146 |
| 622 | 0.082002 | 0.273485 | 0.335066 |
| 623 | 0.006029 | 0.020465 | 0.261982 |
| 624 | 0.140559 | 0.424388 | 0.42443 |
| 625 | 0.005826 | 0.019866 | 0.264531 |
| 626 | 0.051468 | 0.032244 | 0.306101 |
| 627 | 0.075104 | 0.276951 | 0.298932 |
| 628 | 0.005997 | 0.022048 | 0.26821 |
| 629 | 0.034034 | 0.401114 | 0.435605 |
| 630 | 0.011946 | 0.027566 | 0.254444 |
| 631 | 0.005914 | 0.020147 | 0.288981 |
| 632 | 0.037385 | 0.026122 | 0.362523 |
| 633 | 0.005826 | 0.019832 | 0.356419 |
| 634 | 0.010026 | 0.030547 | 0.206994 |
| 635 | 0.01508 | 0.04919 | 0.264614 |
| 636 | 0.296551 | 1.260655 | 0.610765 |
| 637 | 0.032124 | 0.375722 | 0.306647 |
| 638 | 0.005896 | 0.021846 | 0.271964 |
| 639 | 0.018881 | 0.148987 | 0.215144 |
| 640 | 0.018015 | 0.131161 | 0.288994 |
| 641 | 0.032334 | 0.02755 | 0.409355 |
| 642 | 0.067149 | 0.273403 | 0.35373 |
| 643 | 0.094609 | 0.53261 | 0.4944 |
| 644 | 0.006418 | 0.02472 | 0.231759 |
| 645 | 0.131335 | 0.734794 | 0.553125 |
| 646 | 0.029427 | 0.344127 | 0.390884 |
| 647 | 0.023863 | 0.136043 | 0.300959 |
| 650 | 0.010281 | 0.03014 | 0.242733 |
| 651 | 0.007994 | 0.028947 | 0.25194 |
| 652 | 0.15318 | 0.627023 | 0.43527 |
| 653 | 0.118823 | 0.69422 | 0.40527 |
| 654 | 0.105353 | 0.646828 | 0.388119 |
| 656 | 0.006783 | 0.02363 | 0.269316 |
| 657 | 0.307363 | 1.189775 | 0.605584 |
| 658 | 0.142732 | 0.450462 | 0.421859 |
| 659 | 0.22685 | 0.512994 | 0.582274 |
| 660 | 0.088314 | 0.402555 | 0.524885 |
| 661 | 0.180276 | 0.439707 | 0.530249 |
| 662 | 0.010698 | 0.060157 | 0.272901 |
| 663 | 0.161736 | 0.431703 | 0.609228 |
| 664 | 0.104153 | 0.348438 | 0.502663 |
| 665 | 0.509021 | 0.807128 | 0.717144 |
| 666 | 0.474224 | 0.60482 | 0.829418 |
| 667 | 0.04441 | 0.198916 | 0.289447 |
| 668 | 0.072205 | 0.466606 | 0.40305 |
| 669 | 0.026334 | 0.185174 | 0.304685 |
| 670 | 0.108713 | 0.572116 | 0.361198 |
| 671 | 0.054216 | 0.293384 | 0.286724 |
| 672 | 0.089022 | 0.461053 | 0.683679 |
| 673 | 0.052496 | 0.22393 | 0.290818 |
| 674 | 0.242917 | 0.426446 | 0.671781 |
| 675 | 0.020806 | 0.100778 | 0.254393 |
| 676 | 0.120498 | 0.594332 | 0.557211 |
| 677 | 0.083653 | 0.221249 | 0.399649 |
| 678 | 0.006713 | 0.026074 | 0.284843 |
| 679 | 0.012988 | 0.238136 | 0.251857 |
| 680 | 0.939588 | 1.168014 | 0.89748 |
| 682 | 0.116101 | 0.51627 | 0.411418 |
| 683 | 0.091835 | 0.41856 | 0.330861 |
| 684 | 0.269272 | 0.956985 | 0.388996 |
| 685 | 0.068553 | 0.420129 | 0.219238 |
| 686 | 0.118729 | 0.627236 | 0.408928 |
| 687 | 0.109438 | 0.486295 | 0.332833 |
| 688 | 0.136059 | 0.604523 | 0.382106 |
| 689 | 0.029476 | 0.230011 | 0.246326 |
| 690 | 0.713106 | 1.287446 | 0.527058 |
| 691 | 0.237497 | 0.831741 | 0.595391 |
| 692 | 0.223793 | 1.114774 | 0.464139 |
| 693 | 0.271839 | 2.152616 | 0.674694 |
| 694 | 0.05139 | 0.613276 | 0.240255 |
| 695 | 0.327666 | 1.036856 | 0.542561 |
| 696 | 0.098363 | 0.604772 | 0.25928 |
| 697 | 0.375897 | 0.957958 | 0.549728 |
| 698 | 0.026512 | 0.225899 | 0.241871 |
| 699 | 0.497694 | 1.50769 | 0.574673 |
| 700 | 0.288469 | 0.915024 | 0.510727 |
| 701 | 0.437509 | 1.020715 | 0.734873 |
| 702 | 0.046205 | 0.476705 | 0.190078 |
| 703 | 0.122863 | 0.83862 | 0.282447 |
| 704 | 0.147205 | 0.901082 | 0.301388 |
| 705 | 0.223074 | 0.853951 | 0.40577 |
| 706 | 0.008438 | 0.033092 | 0.191812 |
| 707 | 0.394494 | 0.997947 | 0.843619 |
| 708 | 0.186993 | 1.051411 | 0.468843 |
| 709 | 0.108893 | 0.601642 | 0.210326 |
| 710 | 0.091753 | 0.734575 | 0.237951 |
| 711 | 0.345755 | 1.159082 | 0.385849 |
| 712 | 0.115713 | 0.513471 | 0.287018 |
| 713 | 0.122493 | 0.686785 | 0.347889 |
| 714 | 0.191872 | 0.830288 | 0.567754 |
| 715 | 0.016321 | 0.055715 | 0.200218 |
| 716 | 0.020481 | 0.530732 | 0.198959 |
| 717 | 0.039274 | 0.234164 | 0.199885 |
| 718 | 0.344223 | 1.062216 | 0.47539 |
| 719 | 0.034917 | 0.299112 | 0.221854 |
| 720 | 0.149534 | 0.777313 | 0.356745 |
| 721 | 0.35108 | 1.01378 | 0.464163 |
| 722 | 0.234439 | 0.884539 | 0.353844 |
| 723 | 0.0088 | 0.035731 | 0.175315 |
| 724 | 0.302881 | 1.254204 | 0.495122 |
| 725 | 0.05075 | 0.39608 | 0.275113 |
| 726 | 0.081523 | 0.495768 | 0.301285 |
| 727 | 0.043541 | 0.247525 | 0.249821 |
| 728 | 0.33696 | 1.546341 | 0.460674 |
| 729 | 0.359043 | 1.008995 | 0.546047 |
| 730 | 0.097955 | 0.496152 | 0.329261 |
| 731 | 0.072919 | 0.443675 | 0.274429 |
| 732 | 0.015001 | 0.060524 | 0.182808 |
| 733 | 0.453244 | 1.410075 | 0.629982 |
| 734 | 0.342572 | 1.700432 | 0.413281 |
| 735 | 0.012613 | 0.050176 | 0.182816 |
| 736 | 0.016461 | 0.063952 | 0.182823 |
| 738 | 0.482005 | 1.605961 | 0.567678 |
| 739 | 0.58218 | 1.397435 | 0.754253 |
| 740 | 0.029093 | 0.051791 | 0.207152 |
| 741 | 0.349249 | 1.283688 | 0.511103 |
| 742 | 0.04606 | 0.482528 | 0.221214 |
| 743 | 0.141882 | 0.376925 | 2.230581 |
| 744 | 0.254656 | 0.939146 | 0.493241 |
| 745 | 0.015338 | 0.058975 | 0.213153 |
| 746 | 0.340833 | 0.962798 | 0.521323 |
| 747 | 0.701684 | 1.619727 | 0.658665 |
| 748 | 0.442992 | 1.472323 | 0.774321 |
| 749 | 0.196686 | 0.71019 | 0.441595 |
| 750 | 0.00964 | 0.038536 | 0.188239 |
| 751 | 0.360595 | 1.364262 | 0.554156 |
| 752 | 0.32576 | 1.182967 | 0.622747 |
| 753 | 0.066818 | 0.928007 | 0.240297 |
| 754 | 0.017628 | 0.16402 | 0.222692 |
| 755 | 0.237297 | 1.072629 | 0.451982 |
| 756 | 0.178168 | 1.009049 | 0.452329 |
| 757 | 0.012459 | 0.041059 | 0.194411 |
| 758 | 0.007271 | 0.030828 | 0.157203 |
| 759 | 0.031242 | 0.159577 | 0.186227 |
| 761 | 0.043353 | 0.146524 | 0.225515 |
| 762 | 0.007574 | 0.030242 | 0.208583 |
| 763 | 0.008587 | 0.032455 | 0.1986 |
| 764 | 0.008102 | 0.033408 | 0.169696 |
| 765 | 0.008951 | 0.03922 | 0.17488 |
| 766 | 0.018024 | 0.295069 | 0.205724 |
| 767 | 0.124411 | 0.768264 | 0.418591 |
| 768 | 0.008208 | 0.036795 | 0.183375 |

TABLE 27-continued

Expression and functional stability screening of IRES

| SEQ ID NO | [Mod] Fold Change Myo | [Mod] T Fold Change | [Mod] PHH Fold Change |
|---|---|---|---|
| 769 | 0.036346 | 0.37833 | 0.238709 |
| 770 | 0.279379 | 1.535747 | 0.723481 |
| 771 | 0.643475 | 0.520238 | 0.45387 |
| 772 | 0.014665 | 0.047355 | 0.166823 |
| 773 | 0.468419 | 2.022633 | 0.735404 |
| 774 | 0.362808 | 1.622526 | 0.436049 |
| 775 | 0.008859 | 0.038937 | 0.134732 |
| 776 | 0.311065 | 0.985297 | 0.574464 |
| 777 | 0.039862 | 0.065683 | 0.181863 |
| 779 | 0.123206 | 0.450318 | 0.697269 |
| 780 | 0.006814 | 0.029606 | 0.249389 |
| 781 | 0.009967 | 0.031473 | 0.286858 |
| 782 | 0.777497 | 1.325239 | 0.830948 |
| 783 | 0.587889 | 1.292049 | 1.019843 |
| 784 | 0.387894 | 0.821784 | 0.97539 |
| 786 | 0.120025 | 0.185762 | 0.380872 |
| 787 | 0.235698 | 0.942409 | 1.240669 |
| 788 | 0.336218 | 1.269178 | 0.957619 |
| 789 | 0.01732 | 0.096762 | 0.304029 |
| 791 | 0.617079 | 1.629033 | 1.466181 |
| 792 | 0.185997 | 0.704769 | 0.536405 |
| 793 | 0.877167 | 1.831368 | 1.454354 |
| 794 | 0.009408 | 0.076964 | 0.311169 |
| 795 | 0.099921 | 0.429592 | 0.632075 |
| 796 | 0.094809 | 0.536362 | 0.432216 |
| 797 | 0.244954 | 0.482612 | 0.621421 |
| 798 | 0.017916 | 0.084297 | 0.371982 |
| 799 | 0.012818 | 0.047289 | 0.29833 |
| 800 | 0.011675 | 0.13481 | 0.297163 |
| 801 | 0.099266 | 0.273608 | 0.403125 |
| 802 | 0.367887 | 1.18793 | 0.85394 |
| 803 | 0.006742 | 0.027036 | 0.289538 |
| 804 | 0.059456 | 0.162059 | 0.353715 |
| 805 | 0.01413 | 0.033509 | 0.294557 |
| 806 | 0.518086 | 1.610542 | 0.760268 |
| 807 | 0.022595 | 0.066194 | 0.294225 |
| 808 | 0.459064 | 1.277287 | 1.042237 |
| 810 | 0.012544 | 0.05468 | 0.274167 |
| 811 | 0.151174 | 0.538166 | 0.417778 |
| 812 | 0.006597 | 0.025521 | 0.283047 |
| 813 | 0.00961 | 0.027888 | 0.286255 |
| 814 | 0.048257 | 0.855988 | 0.357851 |
| 815 | 0.008921 | 0.03568 | 0.252635 |
| 816 | 0.39553 | 1.021138 | 0.918671 |
| 817 | 0.123764 | 0.912411 | 0.462477 |
| 818 | 0.007052 | 0.060048 | 0.259581 |
| 820 | 0.595672 | 0.572794 | 2.367059 |
| 821 | 0.027009 | 0.077125 | 0.292614 |
| 822 | 0.006996 | 0.035426 | 0.27968 |
| 823 | 0.61953 | 2.009281 | 0.808006 |
| 824 | 0.078118 | 0.029309 | 0.329722 |
| 825 | 0.038471 | 0.505871 | 0.321534 |
| 826 | 0.214307 | 1.236203 | 0.710454 |
| 827 | 0.187119 | 1.091001 | 0.678169 |
| 828 | 0.008155 | 0.032836 | 0.286114 |
| 829 | 0.043091 | 0.374192 | 0.385331 |
| 830 | 0.227057 | 0.993627 | 0.956788 |
| 831 | 0.111249 | 0.782791 | 0.514752 |
| 832 | 0.007741 | 0.034744 | 0.240929 |
| 833 | 0.148308 | 1.302523 | 0.621108 |
| 834 | 0.050544 | 0.635099 | 0.432155 |
| 835 | 0.107654 | 0.475431 | 0.419748 |
| 836 | 0.332776 | 1.197718 | 0.712195 |
| 837 | 0.007024 | 0.02723 | 0.249139 |
| 839 | 0.541139 | 1.487877 | 1.280705 |
| 840 | 0.434719 | 1.514761 | 1.27396 |
| 841 | 0.268407 | 1.048218 | 0.711256 |
| 842 | 0.258083 | 1.028023 | 0.818548 |
| 843 | 0.211266 | 0.691019 | 1.864166 |
| 846 | 0.14662 | 0.821729 | 1.1122 |
| 847 | 0.386867 | 1.568454 | 0.669131 |
| 848 | 0.080316 | 0.56734 | 0.850772 |
| 849 | 0.25383 | 1.721732 | 0.602704 |
| 850 | 0.526909 | 1.78363 | 0.891613 |
| 851 | 0.116222 | 0.76078 | 0.77039 |
| 852 | 0.206702 | 0.560921 | 1.415325 |
| 853 | 0.238304 | 1.081284 | 0.677935 |
| 854 | 0.053709 | 0.430447 | 0.580549 |
| 855 | 0.218825 | 0.941552 | 0.664315 |
| 856 | 0.101452 | 0.224533 | 0.577448 |
| 857 | 0.417144 | 0.902022 | 1.306233 |
| 858 | 0.03876 | 0.729869 | 0.32705 |
| 859 | 0.007745 | 0.034045 | 0.25266 |
| 860 | 0.008348 | 0.045165 | 0.274574 |
| 861 | 0.594983 | 1.639781 | 1.271579 |
| 862 | 0.900769 | 1.57937 | 1.004981 |
| 863 | 0.537996 | 1.331377 | 1.261956 |
| 864 | 0.388698 | 0.891772 | 1.285634 |
| 865 | 0.264661 | 1.079879 | 0.864063 |
| 866 | 0.06028 | 0.22964 | 0.478783 |
| 867 | 0.239258 | 0.716616 | 0.710261 |
| 868 | 0.008279 | 0.030116 | 0.264729 |
| 870 | 0.345182 | 0.941026 | 1.084312 |
| 871 | 0.381332 | 0.702232 | 1.235897 |
| 872 | 0.007184 | 0.0288 | 0.280018 |
| 873 | 0.011191 | 0.037242 | 0.285839 |
| 874 | 0.149494 | 0.617071 | 1.476994 |
| 875 | 0.172408 | 0.907391 | 0.867952 |
| 876 | 0.462175 | 1.088865 | 1.306636 |
| 878 | 0.010338 | 0.034189 | 0.216719 |
| 879 | 0.004925 | 0.019286 | 0.108567 |
| 881 | 0.005183 | 0.020939 | 0.088123 |
| 882 | 0.005094 | 0.020658 | 0.090945 |
| 883 | 0.005435 | 0.022801 | 0.085715 |
| 884 | 0.150855 | 0.669518 | 0.216276 |
| 885 | 0.352227 | 0.729722 | 0.522431 |
| 886 | 0.00519 | 0.04764 | 0.094334 |
| 887 | 0.006618 | 0.067628 | 0.098385 |
| 888 | 0.689507 | 1.833727 | 0.663895 |
| 889 | 0.192102 | 1.196074 | 0.344485 |
| 890 | 0.348046 | 1.61085 | 0.692815 |
| 891 | 0.080898 | 0.580847 | 0.200646 |
| 892 | 0.044425 | 0.718329 | 0.121203 |
| 893 | 0.382721 | 0.843293 | 0.376432 |
| 894 | 0.068781 | 0.640743 | 0.21479 |
| 896 | 0.014415 | 0.055218 | 0.107079 |
| 897 | 0.00687 | 0.027706 | 0.094585 |
| 898 | 0.286212 | 1.357183 | 0.357932 |
| 899 | 0.297653 | 1.1528 | 0.302755 |
| 900 | 0.327981 | 0.932419 | 0.386499 |
| 901 | 0.010727 | 0.05943 | 0.088041 |
| 902 | 0.350484 | 1.180504 | 0.40489 |
| 903 | 0.374566 | 1.622565 | 0.396166 |
| 904 | 0.166397 | 1.049689 | 0.320325 |
| 905 | 0.136541 | 0.817688 | 0.362347 |
| 906 | 0.291429 | 1.325833 | 0.396889 |
| 907 | 0.347797 | 1.267447 | 0.541789 |
| 908 | 0.034779 | 0.467747 | 0.163031 |
| 909 | 0.164487 | 0.350343 | 0.141732 |
| 910 | 0.265078 | 0.886219 | 0.407203 |
| 911 | 0.220201 | 0.717038 | 0.423402 |
| 912 | 0.186388 | 0.85741 | 0.362314 |
| 913 | 0.518467 | 1.762848 | 0.547938 |
| 914 | 0.40602 | 1.766605 | 0.454544 |
| 915 | 0.163459 | 1.042566 | 0.26138 |
| 916 | 0.296433 | 1.092387 | 0.371475 |
| 917 | 0.635553 | 1.261914 | 0.549559 |
| 918 | 0.291057 | 1.006901 | 0.474071 |
| 919 | 0.413799 | 1.246473 | 0.564896 |
| 920 | 0.179531 | 1.451147 | 0.495419 |
| 921 | 0.178932 | 1.285129 | 0.41161 |
| 923 | 0.317288 | 1.146979 | 0.387911 |
| 924 | 0.273164 | 0.914613 | 0.414757 |
| 925 | 0.19808 | 0.725391 | 0.296935 |
| 926 | 0.009777 | 0.035042 | 0.100935 |
| 927 | 0.436574 | 1.262457 | 0.683576 |

TABLE 27-continued

Expression and functional stability screening of IRES

| SEQ ID NO | [Mod] Fold Change Myo | [Mod] T Fold Change | [Mod] PHH Fold Change |
|---|---|---|---|
| 928 | 0.183262 | 0.813709 | 0.402288 |
| 929 | 0.094365 | 0.787482 | 0.213812 |
| 930 | 0.009025 | 0.063975 | 0.099171 |
| 931 | 0.032034 | 0.095047 | 0.131713 |
| 932 | 0.429418 | 1.050149 | 0.621605 |
| 933 | 0.0172 | 0.052524 | 0.099638 |
| 934 | 0.632772 | 1.169765 | 0.781487 |
| 935 | 0.253132 | 1.3481 | 0.278776 |
| 936 | 0.170298 | 1.000176 | 0.277753 |
| 937 | 0.15824 | 0.84717 | 0.442072 |
| 938 | 0.20538 | 0.88334 | 0.432407 |
| 939 | 0.224863 | 0.999881 | 0.380371 |
| 940 | 0.006178 | 0.021918 | 0.089462 |
| 941 | 0.011284 | 0.066173 | 0.115573 |
| 942 | 0.173491 | 0.708929 | 0.733394 |
| 943 | 0.189128 | 1.089849 | 0.316464 |
| 944 | 0.090245 | 0.422225 | 0.480858 |
| 946 | 0.230236 | 0.894889 | 0.396333 |
| 947 | 0.257151 | 0.909063 | 0.325964 |
| 948 | 0.170075 | 0.588195 | 0.260671 |
| 949 | 0.187726 | 0.806307 | 0.331384 |
| 950 | 0.22905 | 0.942413 | 0.603096 |
| 951 | 0.397644 | 0.841753 | 0.3522 |
| 952 | 0.049028 | 0.367599 | 0.253907 |
| 953 | 0.147509 | 0.791804 | 0.804695 |
| 954 | 0.16991 | 0.798194 | 0.475492 |
| 955 | 0.264691 | 0.591625 | 0.406549 |
| 957 | 0.148218 | 0.602345 | 0.46558 |
| 958 | 0.204506 | 0.863187 | 0.592641 |
| 959 | 0.255224 | 1.064249 | 0.774381 |
| 961 | 0.156063 | 1.110527 | 0.516403 |
| 962 | 0.212997 | 1.217959 | 0.365859 |
| 963 | 0.0211 | 0.144681 | 0.150198 |
| 964 | 0.489565 | 1.57383 | 0.615012 |
| 965 | 0.251985 | 0.770085 | 0.522089 |
| 966 | 0.55303 | 0.923252 | 0.527881 |
| 967 | 0.374958 | 1.224169 | 0.526617 |
| 968 | 0.07674 | 0.128785 | 0.431369 |
| 969 | 0.186199 | 0.698537 | 0.472067 |
| 970 | 0.161868 | 0.595542 | 0.889933 |
| 971 | 0.057774 | 0.497863 | 0.206401 |
| 972 | 0.089708 | 0.555687 | 0.328706 |
| 974 | 0.4611 | 1.588992 | 0.988689 |
| 975 | 0.501721 | 1.70434 | 0.729741 |
| 976 | 0.468553 | 1.572864 | 0.520521 |
| 977 | 0.465145 | 1.349452 | 0.80622 |
| 978 | 0.060567 | 1.227042 | 0.179786 |
| 980 | 0.649997 | 2.424418 | 0.991253 |
| 981 | 0.675473 | 1.395536 | 0.799773 |
| 982 | 0.493201 | 1.634458 | 0.836638 |
| 983 | 0.6355 | 4.406334 | 0.657997 |
| 984 | 0.622337 | 2.861176 | 0.393731 |
| 985 | 0.247394 | 1.921413 | 0.406224 |
| 986 | 0.098809 | 1.089629 | 0.184354 |
| 987 | 0.47511 | 2.42364 | 0.361921 |
| 988 | 0.364262 | 1.773289 | 0.713466 |
| 989 | 0.751797 | 1.903482 | 0.467399 |
| 992 | 0.251144 | 1.61049 | 0.379502 |
| 993 | 0.209284 | 1.691842 | 0.44776 |
| 994 | 0.34175 | 2.039731 | 0.798924 |
| 995 | 0.560565 | 3.12071 | 0.388763 |
| 996 | 0.407642 | 3.358356 | 0.353555 |
| 997 | 0.930576 | 2.730102 | 0.497813 |
| 998 | 0.325541 | 2.234049 | 0.512623 |
| 999 | 0.37115 | 2.362841 | 0.625508 |
| 1000 | 0.200748 | 2.565779 | 0.285251 |
| 1001 | 0.101767 | 1.532869 | 0.325446 |
| 1002 | 0.334714 | 3.270477 | 0.575591 |
| 1003 | 0.294501 | 2.785205 | 0.192242 |
| 1004 | 0.42759 | 3.329744 | 0.366353 |
| 1005 | 0.658112 | 2.554948 | 0.265405 |
| 1006 | 0.657566 | 1.865741 | 1.037788 |
| 1007 | 0.428267 | 2.664938 | 0.294918 |
| 1008 | 0.123986 | 1.595956 | 0.302035 |
| 1009 | 0.274442 | 2.817702 | 0.287299 |
| 1010 | 0.238204 | 3.007669 | 0.358667 |
| 1011 | 0.329633 | 2.440677 | 0.33232 |
| 1012 | 0.374152 | 3.023523 | 0.243111 |
| 1013 | 0.040086 | 0.407359 | 0.097212 |
| 1014 | 0.650383 | 2.577328 | 0.702306 |
| 1015 | 0.556326 | 3.822954 | 0.220832 |
| 1016 | 0.286549 | 2.359215 | 0.398523 |
| 1017 | 0.391716 | 5.493401 | 0.257803 |
| 1018 | 0.232929 | 2.135935 | 0.649378 |
| 1019 | 0.28219 | 2.371224 | 0.266729 |
| 1020 | 0.51863 | 2.875937 | 0.340747 |
| 1021 | 0.330813 | 1.726956 | 0.254804 |
| 1022 | 0.017793 | 0.063328 | 0.09479 |
| 1023 | 0.632422 | 5.001505 | 0.355245 |
| 1024 | 0.18462 | 1.771516 | 0.207356 |
| 1025 | 0.252709 | 2.019318 | 0.193805 |
| 1026 | 0.266125 | 3.425025 | 0.244887 |
| 1027 | 0.333355 | 2.88353 | 0.287246 |
| 1028 | 0.279444 | 1.656027 | 0.326932 |
| 1029 | 0.757301 | 2.168554 | 0.177607 |
| 1030 | 0.787768 | 3.103594 | 0.962656 |
| 1031 | 0.485323 | 3.727265 | 0.678268 |
| 1032 | 0.152334 | 1.921508 | 0.428204 |
| 1033 | 0.10525 | 1.592774 | 0.153351 |
| 1034 | 0.017448 | 0.092714 | 0.088247 |
| 1035 | 0.32027 | 2.717977 | 0.197946 |
| 1036 | 0.315469 | 1.59956 | 0.232083 |
| 1037 | 0.583145 | 2.318094 | 0.166805 |
| 1039 | 0.347433 | 2.874902 | 0.471893 |
| 1040 | 0.142964 | 1.920848 | 0.351992 |
| 1042 | 0.202209 | 2.100867 | 0.315035 |
| 1044 | 0.349521 | 2.320673 | 0.253838 |
| 1045 | 0.210983 | 0.761205 | 0.187876 |
| 1046 | 0.090748 | 0.371038 | 0.186849 |
| 1048 | 0.066928 | 0.667905 | 0.236017 |
| 1049 | 0.019242 | 0.114164 | 0.097972 |
| 1051 | 0.317465 | 2.158948 | 0.221567 |
| 1053 | 0.034762 | 0.16757 | 0.098127 |
| 1054 | 1.115094 | 3.572908 | 0.107919 |
| 1055 | 0.426255 | 2.279363 | 0.875474 |
| 1056 | 0.35721 | 2.140493 | 0.659378 |
| 1058 | 0.55246 | 3.14052 | 0.533825 |
| 1059 | 0.282424 | 1.535033 | 0.458698 |
| 1060 | 0.508811 | 3.071866 | 0.445119 |
| 1061 | 0.525733 | 2.601345 | 0.545443 |
| 1062 | 0.723702 | 1.828112 | 0.521941 |
| 1063 | 0.699279 | 2.002368 | 1.090698 |
| 1064 | 0.488057 | 1.746524 | 0.694956 |
| 1065 | 0.525503 | 2.352257 | 0.927797 |
| 1066 | 0.718979 | 3.256654 | 0.939838 |
| 1067 | 0.491483 | 1.809573 | 0.745394 |
| 1068 | 1.179541 | 3.74017 | 0.467877 |
| 1069 | 0.680638 | 2.4638 | 0.562974 |
| 1071 | 0.209584 | 0.500858 | 0.031699 |
| 1072 | 0.427886 | 1.498126 | 0.045503 |
| 1074 | 0.225285 | 0.934492 | 0.092819 |
| 1075 | 0.137715 | 0.599395 | 0.037514 |
| 1076 | 0.218044 | 1.024494 | 0.018691 |
| 1077 | 0.357504 | 1.710835 | 0.077848 |
| 1078 | 0.446448 | 1.518153 | 0.329426 |
| 1079 | 0.068825 | 0.57375 | 0.014851 |
| 1080 | 0.003884 | 0.019354 | 0.011699 |
| 1081 | 0.132094 | 0.892676 | 0.083692 |
| 1082 | 0.11434 | 0.923226 | 0.056705 |
| 1083 | 0.048631 | 0.398633 | 0.030346 |
| 1084 | 0.09557 | 0.924719 | 0.027728 |
| 1085 | 0.319794 | 0.776496 | 0.0123 |
| 1086 | 0.841477 | 2.348773 | 0.384012 |
| 1087 | 0.52158 | 1.199952 | 0.055537 |
| 1088 | 0.078823 | 0.411586 | 0.028465 |
| 1089 | 0.00343 | 0.019524 | 0.010609 |

TABLE 27-continued

Expression and functional stability screening of IRES

| SEQ ID NO | [Mod] Fold Change Myo | [Mod] T Fold Change | [Mod] PHH Fold Change |
|---|---|---|---|
| 1090 | 0.003436 | 0.019498 | 0.011946 |
| 1091 | 0.102675 | 0.821406 | 0.058983 |
| 1092 | 0.106604 | 0.815445 | 0.072592 |
| 1093 | 0.058575 | 0.476647 | 0.055827 |
| 1094 | 0.582942 | 1.352039 | 0.521226 |
| 1095 | 0.274994 | 0.998033 | 0.05091 |
| 1096 | 0.135482 | 0.659134 | 0.082443 |
| 1097 | 0.092301 | 0.934711 | 0.104868 |
| 1098 | 0.128824 | 1.226146 | 0.0726 |
| 1099 | 0.053711 | 0.584595 | 0.057494 |
| 1100 | 0.06731 | 0.735897 | 0.070774 |
| 1101 | 0.112476 | 0.815231 | 0.062219 |
| 1102 | 0.415663 | 1.212428 | 0.079545 |
| 1103 | 0.412005 | 1.754218 | 0.07277 |
| 1104 | 0.094334 | 0.470474 | 0.097149 |
| 1105 | 0.028017 | 0.537236 | 0.024877 |
| 1106 | 0.053871 | 0.742137 | 0.06444 |
| 1107 | 0.095169 | 1.103475 | 0.065829 |
| 1108 | 0.093046 | 0.820538 | 0.035385 |
| 1109 | 0.057641 | 0.482332 | 0.044518 |
| 1110 | 0.455043 | 1.55682 | 0.197962 |
| 1111 | 0.383534 | 1.350223 | 0.034935 |
| 1112 | 0.069077 | 0.719701 | 0.057509 |
| 1113 | 0.039422 | 0.485263 | 0.043295 |
| 1114 | 0.067072 | 0.91085 | 0.025613 |
| 1115 | 0.039005 | 0.503229 | 0.02457 |
| 1116 | 0.033876 | 0.323061 | 0.033704 |
| 1117 | 0.064028 | 0.56885 | 0.033787 |
| 1118 | 0.250182 | 0.508475 | 0.021224 |
| 1119 | 0.37371 | 0.826558 | 0.089181 |
| 1120 | 0.090101 | 0.592721 | 0.06047 |
| 1121 | 0.059672 | 1.02895 | 0.070457 |
| 1122 | 0.02492 | 0.538694 | 0.02872 |
| 1125 | 0.122305 | 0.680083 | 0.045805 |
| 1126 | 0.463398 | 1.267668 | 0.085815 |
| 1127 | 0.238281 | 1.080024 | 0.095938 |
| 1128 | 0.073365 | 0.521087 | 0.063778 |
| 1129 | 0.031089 | 0.393886 | 0.022686 |
| 1130 | 0.093374 | 0.767258 | 0.115614 |
| 1131 | 0.079149 | 0.574318 | 0.048331 |
| 1132 | 0.074191 | 0.643954 | 0.023463 |
| 1133 | 0.062971 | 0.480284 | 0.031931 |
| 1134 | 0.216714 | 2.20506 | 0.132402 |
| 1135 | 0.256515 | 0.844706 | 0.057365 |
| 1136 | 0.10945 | 0.887249 | 0.110266 |
| 1137 | 0.029429 | 0.352312 | 0.033672 |
| 1138 | 0.100706 | 0.864622 | 0.084684 |
| 1139 | 0.068952 | 0.846332 | 0.073941 |
| 1140 | 0.088214 | 0.797631 | 0.063666 |
| 1141 | 0.060094 | 0.359254 | 0.051047 |
| 1142 | 0.449206 | 1.015907 | 0.520133 |
| 1143 | 0.015059 | 0.08374 | 0.013579 |
| 1144 | 0.021431 | 0.415068 | 0.029096 |
| 1145 | 0.065197 | 0.376581 | 0.059013 |
| 1146 | 0.091757 | 0.625511 | 0.054384 |
| 1147 | 0.069289 | 0.534903 | 0.093464 |
| 1148 | 0.09357 | 0.984551 | 0.073067 |
| 1149 | 0.087768 | 0.722494 | 0.041795 |
| 1150 | 0.371622 | 1.089698 | 0.054021 |
| 1151 | 0.2795 | 0.947429 | 0.047765 |
| 1152 | 0.107195 | 0.384755 | 0.042152 |
| 1153 | 0.170766 | 0.881601 | 0.079923 |
| 1154 | 0.165804 | 1.199739 | 0.082085 |
| 1155 | 0.133725 | 0.619659 | 0.096667 |
| 1156 | 0.083408 | 0.615919 | 0.018728 |
| 1157 | 0.005065 | 0.022682 | 0.011868 |
| 1158 | 0.279768 | 0.567474 | 0.470594 |
| 1159 | 0.366023 | 1.092993 | 0.087006 |
| 1160 | 0.27576 | 0.987157 | 0.055226 |
| 1161 | 0.00888 | 0.211542 | 0.013514 |
| 1162 | 0.321948 | 1.123212 | 0.077234 |
| 1163 | 0.238473 | 0.676024 | 0.108033 |
| 1164 | 0.174887 | 0.553471 | 0.031922 |
| 1165 | 0.362907 | 1.060364 | 0.105512 |
| 1167 | 0.440301 | 3.41734 | |
| 1168 | 2.269595 | 6.148748 | |
| 1169 | 1.81238 | 4.676323 | |
| 1170 | 0.205013 | 0.821177 | |
| 1171 | 1.757897 | 3.916135 | |
| 1172 | 1.485171 | 1.939494 | |
| 1173 | 0.294994 | 0.522214 | |
| 1174 | 0.375652 | 1.011377 | |
| 1175 | 0.751857 | 4.08474 | |
| 1176 | 0.543517 | 3.338898 | |
| 1177 | 1.544519 | 7.245177 | |
| 1178 | 0.736878 | 2.629057 | |
| 1179 | 0.686547 | 2.072089 | |
| 1180 | 0.237255 | 0.98724 | |
| 1182 | 0.654624 | 1.237891 | |
| 1183 | 0.909645 | 4.061809 | |
| 1184 | 0.544952 | 2.024292 | |
| 1185 | 0.147863 | 1.25923 | |
| 1186 | 0.434429 | 1.954991 | |
| 1187 | 0.505786 | 3.505564 | |
| 1188 | 0.406861 | 2.548182 | |
| 1189 | 0.4624 | 2.051662 | |
| 1190 | 0.071895 | 0.226536 | |
| 1191 | 0.02375 | 0.087245 | |
| 1192 | 1.717893 | 7.465639 | |
| 1193 | 0.542623 | 4.373519 | |
| 1194 | 0.354838 | 3.577394 | |
| 1195 | 0.259933 | 3.12244 | |
| 1196 | 0.215423 | 2.052223 | |
| 1197 | 0.526893 | 2.109184 | |
| 1198 | 0.822275 | 1.940819 | |
| 1199 | 2.037406 | 9.409115 | |
| 1200 | 1.095359 | 5.130504 | |
| 1201 | 0.157644 | 0.731059 | |
| 1202 | 0.230264 | 1.923086 | |
| 1204 | 0.044579 | 0.913551 | |
| 1206 | 0.511955 | 1.209704 | |
| 1207 | 0.046192 | 0.162052 | |
| 1208 | 0.026908 | 0.124359 | |
| 1209 | 0.281822 | 3.216097 | |
| 1210 | 0.220147 | 2.427366 | |
| 1211 | 0.111229 | 1.298379 | |
| 1213 | 0.141412 | 0.865279 | |
| 1214 | 0.15488 | 0.459765 | |
| 1215 | 0.997818 | 3.321803 | |
| 1216 | 1.025901 | 4.406269 | |
| 1217 | 0.260845 | 2.930463 | |
| 1218 | 0.345315 | 3.143776 | |
| 1219 | 0.305255 | 1.957145 | |
| 1220 | 0.172212 | 1.168102 | |
| 1221 | 0.248967 | 0.814305 | |
| 1222 | 0.03732 | 0.119114 | |
| 1223 | 1.247387 | 3.024953 | |
| 1224 | 0.024175 | 0.081463 | |
| 1225 | 0.057454 | 0.455597 | |
| 1226 | 0.361586 | 4.237747 | |
| 1227 | 0.15804 | 1.518132 | |
| 1228 | 0.015375 | 0.056146 | |
| 1229 | 0.444241 | 1.249649 | |
| 1230 | 0.649691 | 1.15827 | |
| 1232 | 0.378509 | 0.925671 | |
| 1233 | 0.325411 | 2.625939 | |
| 1234 | 0.206621 | 2.051787 | |
| 1235 | 0.019165 | 0.09314 | |
| 1236 | 0.118642 | 1.658952 | |
| 1237 | 0.017709 | 0.057603 | |
| 1238 | 0.015895 | 0.043364 | |
| 1239 | 0.025104 | 0.079453 | |
| 1240 | 0.361175 | 2.493372 | |
| 1242 | 0.325351 | 1.821619 | |
| 1243 | 0.411323 | 2.267424 | |
| 1244 | 0.262681 | 1.368943 | |

TABLE 27-continued

Expression and functional stability screening of IRES

| SEQ ID NO | [Mod] Fold Change Myo | [Mod] T Fold Change | [Mod] PHH Fold Change |
|---|---|---|---|
| 1245 | 0.209877 | 1.009418 | |
| 1246 | 0.689115 | 0.935799 | |
| 1247 | 1.206727 | 3.45224 | |
| 1248 | 0.997846 | 3.186952 | |
| 1249 | 1.03331 | 4.151541 | |
| 1250 | 0.526962 | 1.830667 | |
| 1251 | 0.038789 | 0.160427 | |
| 1252 | 0.529876 | 1.476753 | |
| 1253 | 0.148526 | 0.512689 | |
| 1254 | 0.171619 | 0.496272 | |
| 1255 | 1.440028 | 4.650389 | |
| 1256 | 1.246323 | 3.526473 | |
| 1257 | 1.630471 | 3.27436 | |
| 1258 | 1.175351 | 3.563138 | |
| 1259 | 0.846546 | 1.714691 | |
| 1260 | 1.043862 | 0.869917 | |
| 1261 | 0.290872 | 0.44244 | |
| 1263 | 0.493679 | 0.657699 | 1.716926 |
| 1264 | 0.298742 | 0.443995 | 1.012966 |
| 1265 | 0.378744 | 0.471388 | 1.244712 |
| 1266 | 0.211218 | 0.327944 | 0.97188 |
| 1267 | 0.17315 | 0.41676 | 1.57404 |
| 1268 | 0.213092 | 0.396399 | 1.097609 |
| 1269 | 0.227781 | 0.372048 | 1.433456 |
| 1270 | 0.004499 | 0.018835 | 1.068802 |
| 1271 | 0.180553 | 0.407587 | 1.83541 |
| 1272 | 0.394666 | 0.599394 | 1.66783 |
| 1273 | 0.281898 | 0.489728 | 1.50982 |
| 1274 | 0.243913 | 0.319871 | 0.788908 |
| 1275 | 0.262209 | 0.4805 | 3.95034 |
| 1276 | 0.378342 | 0.610004 | 1.467933 |
| 1277 | 0.273883 | 0.469937 | 1.070136 |
| 1278 | 0.315846 | 0.734033 | 0.89974 |
| 1279 | 0.189246 | 0.354251 | 6.159851 |
| 1280 | 0.388472 | 0.494888 | 1.410746 |
| 1281 | 0.00514 | 0.020652 | 0.591781 |
| 1282 | 0.289013 | 0.482967 | 2.197797 |
| 1283 | 0.053841 | 0.067338 | 0.927451 |
| 1284 | 0.570301 | 0.633162 | 2.538618 |
| 1285 | 0.255977 | 0.464247 | 1.400939 |
| 1286 | 0.003738 | 0.01781 | 0.498459 |
| 1287 | 0.422493 | 0.771168 | 1.722777 |
| 1288 | 0.373076 | 0.512993 | 1.52444 |
| 1289 | 0.003707 | 0.017964 | 0.668949 |
| 1290 | 0.02527 | 0.048054 | 0.658627 |
| 1291 | 0.010359 | 0.025134 | 0.65155 |
| 1292 | 0.018398 | 0.043801 | 0.757339 |
| 1293 | 0.01987 | 0.051117 | 0.725236 |
| 1294 | 0.010602 | 0.029974 | 0.799556 |
| 1295 | 0.008196 | 0.027605 | 0.669465 |
| 1296 | 0.062396 | 0.233757 | 1.952551 |
| 1298 | 0.003269 | 0.017718 | 0.60053 |
| 1302 | 0.003654 | 0.017971 | 0.669614 |
| 1453 | 0.029035 | 0.074756 | 1.361452 |
| 1456 | 0.070888 | 0.141499 | 1.733833 |
| 1457 | 0.005302 | 0.02091 | 0.86533 |
| 1458 | 0.022487 | 0.056128 | 0.69949 |
| 1459 | 0.041481 | 0.10652 | 1.298416 |
| 1460 | 0.178585 | 0.283471 | 1.592463 |
| 1461 | 0.003819 | 0.018816 | 0.634444 |
| 1462 | 0.089803 | 0.219634 | 2.496717 |
| 1463 | 0.367361 | 0.489496 | 3.718475 |
| 1465 | 0.05509 | 0.079253 | 0.882252 |
| 1466 | 0.125624 | 0.195771 | 1.647541 |
| 1467 | 0.104653 | 0.186069 | 1.135532 |
| 1468 | 0.036721 | 0.09977 | 0.954748 |
| 1469 | 0.12058 | 0.220731 | 1.105286 |
| 1470 | 0.107829 | 0.199073 | 0.937104 |
| 1471 | 0.112351 | 0.216795 | 1.247919 |
| 1472 | 0.229734 | 0.29791 | 1.053188 |
| 1473 | 0.005236 | 0.020279 | 0.786991 |
| 1474 | 0.094218 | 0.183605 | 2.872396 |
| 1475 | 0.103852 | 0.178429 | 2.934125 |
| 1476 | 0.032997 | 0.071639 | 1.468191 |
| 1477 | 0.004763 | 0.019988 | 0.744601 |
| 1479 | 0.004862 | 0.02006 | 0.646639 |
| 1480 | 0.062493 | 0.120887 | 1.421179 |
| 1482 | 0.063512 | 0.117236 | 1.02612 |
| 1483 | 0.003687 | 0.018638 | 0.806893 |
| 1485 | 0.002923 | 0.016326 | 0.810278 |
| 1486 | 0.003046 | 0.016492 | 0.639067 |
| 1487 | 0.002997 | 0.016251 | 0.874065 |
| 1488 | 0.002931 | 0.015913 | 0.718561 |
| 1489 | 0.00278 | 0.016262 | 0.945829 |
| 1490 | 0.003396 | 0.017309 | 0.839493 |
| 1491 | 0.002835 | 0.016415 | 0.616515 |
| 1492 | 0.00337 | 0.017996 | 0.87573 |
| 1493 | 0.002838 | 0.016276 | 0.706791 |
| 1494 | 0.002936 | 0.016453 | 0.886075 |
| 1496 | 0.003021 | 0.016335 | 0.634456 |
| 1497 | 0.002921 | 0.016072 | 0.841508 |
| 1498 | 0.002932 | 0.016361 | 0.582778 |
| 1499 | 0.002819 | 0.017478 | 0.948983 |
| 1500 | 0.003006 | 0.017306 | 0.604048 |
| 1501 | 0.002807 | 0.016489 | 0.785628 |
| 1502 | 0.002769 | 0.015804 | 0.755524 |
| 1503 | 0.002882 | 0.016466 | 0.819839 |
| 1504 | 0.003412 | 0.016569 | 0.709579 |
| 1505 | 0.003997 | 0.017625 | 0.888899 |
| 1506 | 0.00289 | 0.017248 | 0.894677 |
| 1507 | 0.002795 | 0.01699 | 0.79213 |
| 1508 | 0.002911 | 0.016103 | 0.775025 |
| 1509 | 0.002935 | 0.016148 | 0.746427 |
| 1510 | 0.002847 | 0.016713 | 0.598686 |
| 1511 | 0.002895 | 0.016502 | 0.768356 |
| 1512 | 0.003954 | 0.017185 | 0.677016 |
| 1514 | 0.002815 | 0.027933 | 0.931244 |
| 1515 | 0.002933 | 0.027695 | 0.651567 |
| 1516 | 0.002785 | 0.026655 | 0.652685 |
| 1517 | 0.002783 | 0.027738 | 0.565322 |
| 1518 | 0.002828 | 0.026694 | 0.631511 |
| 1519 | 0.002834 | 0.027337 | 0.66479 |
| 1520 | 0.003453 | 0.028188 | 0.710203 |
| 1521 | 0.002992 | 0.026775 | 0.61482 |
| 1522 | 0.003072 | 0.028592 | 0.83538 |
| 1523 | 0.003473 | 0.028775 | 0.571612 |
| 1524 | 0.002805 | 0.027075 | 0.704035 |
| 1525 | 0.003615 | 0.030549 | 0.735642 |
| 1526 | 0.002812 | 0.027292 | 0.770641 |
| 1527 | 0.00283 | 0.026705 | 0.696095 |
| 1528 | 0.002794 | 0.026616 | 0.600694 |
| 1529 | 0.002883 | 0.026458 | 0.557503 |
| 1530 | 0.002978 | 0.028069 | 0.812791 |
| 1532 | 0.002984 | 0.027308 | 0.532545 |
| 1533 | 0.00285 | 0.02682 | 0.563657 |
| 1534 | 0.002846 | 0.02764 | 0.746323 |
| 1536 | 0.002799 | 0.027063 | 0.751124 |
| 1537 | 0.002812 | 0.02665 | 0.629611 |
| 1538 | 0.002753 | 0.026783 | 0.503323 |
| 1539 | 0.002909 | 0.027333 | 0.504615 |
| 1540 | 0.002819 | 0.027702 | 0.694792 |
| 1541 | 0.002759 | 0.02709 | 0.560466 |
| 1542 | 0.002733 | 0.027285 | 0.651773 |
| 1543 | 0.002765 | 0.026253 | 0.573015 |
| 1544 | 0.002706 | 0.027092 | 0.654941 |
| 1545 | 0.002874 | 0.026632 | 0.714128 |
| 1546 | 0.00294 | 0.027778 | 0.636466 |
| 1548 | 0.00279 | 0.028079 | 0.706656 |
| 1549 | 0.002731 | 0.027168 | 0.522207 |
| 1550 | 0.002677 | 0.027476 | 0.696415 |
| 1551 | 0.002816 | 0.027408 | 0.60935 |
| 1552 | 0.002864 | 0.027019 | 0.564324 |
| 1553 | 0.00289 | 0.027219 | 0.656982 |
| 1554 | 0.002904 | 0.027245 | 0.709589 |
| 1555 | 0.002857 | 0.027357 | 0.770251 |
| 1556 | 0.002779 | 0.027449 | 0.600841 |

TABLE 27-continued

Expression and functional stability screening of IRES

| SEQ ID NO | [Mod] Fold Change Myo | [Mod] T Fold Change | [Mod] PHH Fold Change |
|---|---|---|---|
| 1557 | 0.002804 | 0.027851 | 0.819866 |
| 1558 | 0.002822 | 0.027061 | 0.698614 |
| 1559 | 0.002789 | 0.026908 | 0.526565 |
| 1560 | 0.002867 | 0.02696 | 0.567773 |
| 1561 | 0.002954 | 0.026183 | 0.535325 |
| 1562 | 0.002832 | 0.028297 | 0.591001 |
| 1563 | 0.002851 | 0.026715 | 0.518507 |
| 1564 | 0.002773 | 0.027867 | 0.574878 |
| 1565 | 0.002829 | 0.027062 | 0.707218 |
| 1566 | 0.002787 | 0.027944 | 0.60274 |
| 1567 | 0.002789 | 0.026836 | 0.681669 |
| 1568 | 0.002819 | 0.026247 | 0.679288 |
| 1569 | 0.00288 | 0.026881 | 0.755689 |
| 1570 | 0.002853 | 0.026701 | 0.743775 |
| 1571 | 0.002811 | 0.027011 | 0.525869 |
| 1572 | 0.00285 | 0.027158 | 0.513429 |
| 1573 | 0.002801 | 0.027285 | 0.801479 |
| 1574 | 0.00283 | 0.026694 | 0.625502 |
| 1575 | 0.002879 | 0.026776 | 0.59054 |
| 1576 | 0.002797 | 0.026677 | 0.838621 |
| 1577 | 0.003048 | 0.027552 | 0.622979 |
| 1578 | 0.002889 | 0.027386 | 0.598139 |
| 1579 | 0.002955 | 0.027358 | 0.491017 |
| 1580 | 0.002857 | 0.026945 | 0.435188 |
| 1581 | 0.002782 | 0.02785 | 0.477584 |
| 1582 | 0.00277 | 0.026769 | 0.585209 |
| 1583 | 0.002882 | 0.027091 | 0.705566 |
| 1584 | 0.002823 | 0.026051 | 0.588066 |
| 1585 | 0.003011 | 0.02627 | 0.645734 |
| 1586 | 0.002783 | 0.027931 | 0.509146 |
| 1587 | 0.002834 | 0.027194 | 0.594226 |
| 1588 | 0.002788 | 0.027098 | 0.522658 |
| 1589 | 0.002909 | 0.027134 | 0.76665 |
| 1590 | 0.002772 | 0.026947 | 0.590476 |
| 1592 | 0.002841 | 0.026809 | 0.671333 |
| 1593 | 0.002895 | 0.026378 | 0.470406 |
| 1594 | 0.00308 | 0.026761 | 0.571625 |
| 1595 | 0.00292 | 0.026874 | 0.592748 |
| 1596 | 0.002734 | 0.02666 | 0.615701 |
| 1597 | 0.00288 | 0.026918 | 0.694078 |
| 1598 | 0.002796 | 0.028141 | 0.728341 |
| 1599 | 0.003183 | 0.027135 | 0.584021 |
| 1600 | 0.003303 | 0.02835 | 0.463076 |
| 1601 | 0.003179 | 0.02638 | 0.376498 |
| 1602 | 0.004066 | 0.027302 | 0.787392 |
| 1603 | 0.003293 | 0.027454 | 0.565816 |
| 1604 | 0.002846 | 0.02701 | 0.748421 |
| 1605 | 0.005887 | 0.032685 | 0.622649 |
| 1606 | 0.002889 | 0.02704 | 0.56754 |
| 1607 | 0.002831 | 0.026806 | 0.743947 |
| 1608 | 0.002965 | 0.027359 | 0.760013 |
| 1609 | 0.00396 | 0.027561 | 0.674454 |
| 1611 | 0.008586 | 0.075287 | 0.257982 |
| 1612 | 0.009539 | 0.076797 | 0.197109 |
| 1613 | 0.008018 | 0.072467 | 0.231769 |
| 1614 | 0.012023 | 0.075871 | 0.172221 |
| 1615 | 0.008328 | 0.071072 | 0.220705 |
| 1616 | 0.012023 | 0.075453 | 0.25357 |
| 1617 | 0.012384 | 0.075749 | 0.189438 |
| 1618 | 0.009907 | 0.074134 | 0.228244 |
| 1621 | 0.007789 | 0.070227 | 0.245667 |
| 1622 | 0.008908 | 0.072407 | 0.245921 |
| 1623 | 0.011175 | 0.077951 | 0.188074 |
| 1624 | 0.008036 | 0.069872 | 0.246323 |
| 1625 | 0.011073 | 0.074178 | 0.233123 |
| 1626 | 0.012397 | 0.076047 | 0.205037 |
| 1627 | 0.01196 | 0.082003 | 0.236073 |
| 1628 | 0.008087 | 0.073661 | 0.162851 |
| 1629 | 0.009228 | 0.071361 | 0.1983 |
| 1630 | 0.00787 | 0.068021 | 0.252184 |
| 1632 | 0.008463 | 0.070379 | 0.220109 |
| 1633 | 0.008069 | 0.070751 | 0.186138 |
| 1634 | 0.010343 | 0.072986 | 0.210934 |
| 1635 | 0.009638 | 0.077485 | 0.263883 |
| 1636 | 0.008719 | 0.074615 | 0.259029 |
| 1637 | 0.008512 | 0.073437 | 0.167086 |
| 1638 | 0.007929 | 0.072165 | 0.163977 |
| 1639 | 0.007868 | 0.07025 | 0.216269 |
| 1640 | 0.010217 | 0.075129 | 0.212716 |
| 1641 | 0.009846 | 0.072375 | 0.229234 |
| 1642 | 0.008044 | 0.072899 | 0.146821 |
| 1643 | 0.007903 | 0.073916 | 0.202451 |
| 1644 | 0.007997 | 0.072045 | 0.2269 |
| 1645 | 0.008005 | 0.071968 | 0.225724 |
| 1646 | 0.007868 | 0.072947 | 0.218694 |
| 1647 | 0.007874 | 0.07009 | 0.204347 |
| 1648 | 0.008126 | 0.072838 | 0.231684 |
| 1649 | 0.007985 | 0.07098 | 0.217341 |
| 1650 | 0.00805 | 0.073491 | 0.157452 |
| 1651 | 0.008583 | 0.074894 | 0.221222 |
| 1652 | 0.00782 | 0.073647 | 0.23366 |
| 1653 | 0.007727 | 0.072533 | 0.274822 |
| 1654 | 0.007898 | 0.072049 | 0.19207 |
| 1655 | 0.007809 | 0.072421 | 0.239521 |
| 1656 | 0.00814 | 0.070844 | 0.233632 |
| 1657 | 0.008044 | 0.069952 | 0.173161 |
| 1658 | 0.008147 | 0.070865 | 0.114916 |
| 1659 | 0.008054 | 0.070011 | 0.234503 |
| 1660 | 0.008051 | 0.073257 | 0.209313 |
| 1661 | 0.008006 | 0.073666 | 0.220585 |
| 1662 | 0.007882 | 0.072722 | 0.194041 |
| 1663 | 0.0079 | 0.07183 | 0.209789 |
| 1664 | 0.008074 | 0.069676 | 0.185531 |
| 1665 | 0.00878 | 0.071074 | 0.21086 |
| 1666 | 0.007895 | 0.071838 | 0.244376 |
| 1668 | 0.008053 | 0.072861 | 0.253493 |
| 1669 | 0.007873 | 0.073223 | 0.198109 |
| 1670 | 0.007816 | 0.068945 | 0.206857 |
| 1671 | 0.007989 | 0.071814 | 0.303432 |
| 1672 | 0.008207 | 0.073024 | 0.222844 |
| 1673 | 0.008259 | 0.0722 | 0.255081 |
| 1674 | 0.008145 | 0.071765 | 0.197578 |
| 1675 | 0.008243 | 0.07316 | 0.202955 |
| 1676 | 0.008121 | 0.07247 | 0.197388 |
| 1677 | 0.008023 | 0.071901 | 0.24222 |
| 1678 | 0.008907 | 0.074766 | 0.187839 |
| 1679 | 0.007883 | 0.072372 | 0.198258 |
| 1680 | 0.008303 | 0.07202 | 0.20641 |
| 1681 | 0.008051 | 0.068996 | 0.172375 |
| 1682 | 0.008184 | 0.073282 | 0.285672 |
| 1684 | 0.008361 | 0.072729 | 0.170928 |
| 1685 | 0.008716 | 0.074393 | 0.222029 |
| 1686 | 0.008059 | 0.071129 | 0.196348 |
| 1687 | 0.007953 | 0.070337 | 0.21236 |
| 1688 | 0.008643 | 0.070881 | 0.227238 |
| 1689 | 0.007905 | 0.069917 | 0.19241 |
| 1690 | 0.008127 | 0.072187 | 0.219756 |
| 1691 | 0.007958 | 0.073297 | 0.230226 |
| 1692 | 0.00806 | 0.069949 | 0.25326 |
| 1693 | 0.008331 | 0.073454 | 0.232442 |
| 1694 | 0.00995 | 0.07389 | 0.245006 |
| 1695 | 0.00813 | 0.070796 | 0.208166 |
| 1696 | 0.00828 | 0.070973 | 0.196401 |
| 1697 | 0.008427 | 0.070372 | 0.211389 |
| 1698 | 0.010244 | 0.071351 | 0.23418 |
| 1699 | 0.008127 | 0.071392 | 0.186818 |
| 1700 | 0.011627 | 0.078038 | 0.216352 |
| 1701 | 0.008158 | 0.071674 | 0.235836 |
| 1702 | 0.008405 | 0.072728 | 0.214028 |
| 1703 | 0.00931 | 0.072866 | 0.24933 |
| 1704 | 0.00834 | 0.06923 | 0.178878 |
| 1705 | 0.00998 | 0.07348 | 0.262106 |
| 1707 | 0.004095 | 0.007786 | 0.905391 |
| 1708 | 0.00319 | 0.007636 | 0.918093 |
| 1710 | 0.003179 | 0.007381 | 0.810737 |
| 1711 | 0.003206 | 0.007316 | 0.948158 |

TABLE 27-continued

Expression and functional stability screening of IRES

| SEQ ID NO | [Mod] Fold Change Myo | [Mod] T Fold Change | [Mod] PHH Fold Change |
|---|---|---|---|
| 1712 | 0.003223 | 0.007633 | 0.992454 |
| 1713 | 0.003147 | 0.007825 | 1.018484 |
| 1714 | 0.003156 | 0.007799 | 1.011062 |
| 1715 | 0.003144 | 0.007846 | 1.03755 |
| 1716 | 0.003126 | 0.007534 | 0.995065 |
| 1717 | 0.003303 | 0.008123 | 0.95218 |
| 1718 | 0.003174 | 0.007598 | 0.739364 |
| 1720 | 0.003107 | 0.007531 | 0.963791 |
| 1721 | 0.003184 | 0.007393 | 0.642433 |
| 1722 | 0.003234 | 0.007679 | 1.087014 |
| 1723 | 0.003183 | 0.007625 | 0.746413 |
| 1725 | 0.003166 | 0.00732 | 0.983384 |
| 1726 | 0.003192 | 0.007532 | 0.92262 |
| 1727 | 0.003216 | 0.007484 | 0.718343 |
| 1728 | 0.003213 | 0.00725 | 0.952505 |
| 1729 | 0.003225 | 0.007421 | 0.911589 |
| 1730 | 0.003281 | 0.007498 | 0.995307 |
| 1731 | 0.003053 | 0.007481 | 0.950875 |
| 1732 | 0.00316 | 0.007479 | 0.757397 |
| 1733 | 0.003214 | 0.007451 | 0.940672 |
| 1734 | 0.003219 | 0.007427 | 0.893661 |
| 1735 | 0.003254 | 0.007528 | 0.836399 |
| 1737 | 0.003227 | 0.007374 | 0.911326 |
| 1738 | 0.003214 | 0.007477 | 1.002511 |
| 1739 | 0.00327 | 0.008719 | 0.956423 |
| 1740 | 0.003147 | 0.007789 | 1.00538 |
| 1741 | 0.003279 | 0.007904 | 0.975752 |
| 1742 | 0.003162 | 0.007423 | 1.22881 |
| 1743 | 0.003139 | 0.007692 | 0.743436 |
| 1744 | 0.003205 | 0.007379 | 0.772479 |
| 1745 | 0.003182 | 0.007429 | 1.079506 |
| 1747 | 0.003253 | 0.0075 | 0.816336 |
| 1748 | 0.003362 | 0.008459 | 0.998276 |
| 1749 | 0.003015 | 0.007458 | 0.936332 |
| 1750 | 0.003212 | 0.008153 | 0.859119 |
| 1752 | 0.003259 | 0.007776 | 0.978627 |
| 1753 | 0.00325 | 0.007387 | 0.786866 |
| 1754 | 0.003162 | 0.006997 | 1.003224 |
| 1755 | 0.003259 | 0.007394 | 0.925965 |
| 1756 | 0.00318 | 0.007571 | 1.096225 |
| 1758 | 0.003337 | 0.007882 | 0.985142 |
| 1759 | 0.003418 | 0.008082 | 0.953122 |
| 1760 | 0.003232 | 0.007565 | 0.769634 |
| 1761 | 0.003209 | 0.007716 | 0.826567 |
| 1762 | 0.003197 | 0.007352 | 0.743692 |
| 1763 | 0.003236 | 0.007511 | 1.040475 |
| 1764 | 0.003251 | 0.007572 | 1.383275 |
| 1765 | 0.003257 | 0.013774 | 0.819945 |
| 1766 | 0.003138 | 0.007452 | 0.976752 |
| 1767 | 0.003206 | 0.007674 | 0.936511 |
| 1768 | 0.003234 | 0.008193 | 0.717088 |
| 1769 | 0.003178 | 0.007449 | 0.913192 |
| 1771 | 0.003187 | 0.007352 | 0.941054 |
| 1772 | 0.005576 | 0.019795 | 0.767377 |
| 1773 | 0.003294 | 0.012787 | 0.583382 |
| 1774 | 0.003183 | 0.007692 | 0.809862 |
| 1775 | 0.003131 | 0.007429 | 1.000089 |
| 1776 | 0.003174 | 0.007465 | 0.908376 |
| 1777 | 0.003238 | 0.00771 | 1.13952 |
| 1778 | 0.003232 | 0.007417 | 0.854898 |
| 1779 | 0.003218 | 0.007322 | 0.736095 |
| 1780 | 0.003511 | 0.008457 | 0.949085 |
| 1781 | 0.003302 | 0.009751 | 0.834468 |
| 1782 | 0.003093 | 0.007604 | 0.813662 |
| 1783 | 0.003061 | 0.007604 | 0.894994 |
| 1784 | 0.003161 | 0.007326 | 0.70474 |
| 1785 | 0.003225 | 0.007357 | 0.699541 |
| 1786 | 0.003164 | 0.007261 | 0.794668 |
| 1787 | 0.00315 | 0.007418 | 0.964931 |
| 1788 | 0.003283 | 0.007843 | 0.946281 |
| 1789 | 0.003291 | 0.007593 | 0.936091 |
| 1790 | 0.003761 | 0.00877 | 0.886762 |
| 1791 | 0.003112 | 0.007642 | 0.918008 |
| 1792 | 0.003268 | 0.007666 | 0.703354 |
| 1793 | 0.003133 | 0.007455 | 0.842638 |
| 1794 | 0.003159 | 0.007349 | 0.728775 |
| 1795 | 0.003246 | 0.007273 | 0.745148 |
| 1796 | 0.003613 | 0.007904 | 0.628593 |
| 1797 | 0.00427 | 0.008685 | 0.659605 |
| 1798 | 0.003091 | 0.007893 | 0.885414 |
| 1799 | 0.003119 | 0.007443 | 1.016389 |
| 1801 | 0.005041 | 0.009766 | 0.788892 |
| 1802 | 0.003799 | 0.009741 | 0.970487 |
| 1803 | 0.003191 | 0.007455 | 0.811591 |
| 1804 | 0.003256 | 0.007526 | 0.980185 |
| 1806 | 0.007832 | 0.015298 | 0.668837 |
| 1808 | 0.002099 | 0.00239 | 0.713927 |
| 1809 | 0.003792 | 0.004621 | 0.798598 |
| 1810 | 0.002017 | 0.002054 | 0.778629 |
| 1811 | 0.001935 | 0.002012 | 0.827105 |
| 1812 | 0.001955 | 0.002041 | 0.652207 |
| 1813 | 0.002017 | 0.002107 | 1.07398 |
| 1814 | 0.001992 | 0.00212 | 0.938161 |
| 1815 | 0.002057 | 0.002093 | 0.672235 |
| 1816 | 0.002067 | 0.002143 | 0.813551 |
| 1817 | 0.001993 | 0.00201 | 0.666663 |
| 1818 | 0.001943 | 0.002032 | 1.177111 |
| 1819 | 0.002001 | 0.002046 | 0.840791 |
| 1820 | 0.00202 | 0.002025 | 0.821089 |
| 1821 | 0.010528 | 0.014897 | 1.05278 |
| 1822 | 0.001978 | 0.002002 | 0.847594 |
| 1823 | 0.002033 | 0.002129 | 0.923411 |
| 1824 | 0.001995 | 0.002089 | 0.931098 |
| 1825 | 0.001951 | 0.002044 | 0.72614 |
| 1826 | 0.001901 | 0.002026 | 0.969977 |
| 1827 | 0.002017 | 0.002057 | 1.124311 |
| 1828 | 0.002003 | 0.002006 | 0.621247 |
| 1829 | 0.002024 | 0.002243 | 0.826881 |
| 1830 | 0.001924 | 0.001957 | 0.830188 |
| 1831 | 0.002058 | 0.002061 | 1.08971 |
| 1832 | 0.002021 | 0.002227 | 0.99019 |
| 1833 | 0.001961 | 0.002 | 1.043679 |
| 1834 | 0.001997 | 0.002049 | 1.079505 |
| 1835 | 0.002924 | 0.036425 | 0.9315 |
| 1836 | 0.002051 | 0.002049 | 0.764385 |
| 1837 | 0.001987 | 0.002013 | 0.939205 |
| 1838 | 0.001986 | 0.002074 | 0.945167 |
| 1839 | 0.00206 | 0.002081 | 0.757964 |
| 1840 | 0.001961 | 0.002069 | 0.963668 |
| 1841 | 0.001918 | 0.001952 | 0.824621 |
| 1842 | 0.001947 | 0.00206 | 0.828898 |
| 1844 | 0.002009 | 0.002099 | 0.812678 |
| 1845 | 0.001913 | 0.002007 | 0.924997 |
| 1846 | 0.002008 | 0.002012 | 1.067461 |
| 1847 | 0.002012 | 0.002021 | 0.910096 |
| 1848 | 0.002014 | 0.002092 | 1.070281 |
| 1849 | 0.00198 | 0.002053 | 1.115724 |
| 1850 | 0.00196 | 0.002017 | 0.780307 |
| 1851 | 0.001999 | 0.002057 | 0.88249 |
| 1852 | 0.001974 | 0.002022 | 0.630003 |
| 1853 | 0.00197 | 0.001976 | 0.893397 |
| 1854 | 0.002051 | 0.002022 | 0.767922 |
| 1855 | 0.002001 | 0.002064 | 1.128736 |
| 1856 | 0.002104 | 0.002101 | 1.08652 |
| 1857 | 0.001954 | 0.002061 | 0.814235 |
| 1858 | 0.001944 | 0.002018 | 0.855267 |
| 1859 | 0.001923 | 0.002007 | 1.245303 |
| 1860 | 0.001933 | 0.002022 | 0.820898 |
| 1861 | 0.001984 | 0.001993 | 0.92614 |
| 1862 | 0.002019 | 0.002032 | 1.0456 |
| 1863 | 0.002124 | 0.002046 | 0.904399 |
| 1864 | 0.002036 | 0.002068 | 0.957025 |
| 1865 | 0.001969 | 0.002058 | 0.878785 |
| 1866 | 0.001941 | 0.002003 | 0.88721 |
| 1867 | 0.001968 | 0.002036 | 0.765442 |
| 1868 | 0.002326 | 0.002549 | 0.633458 |

TABLE 27-continued

Expression and functional stability screening of IRES

| SEQ ID NO | [Mod] Fold Change Myo | [Mod] T Fold Change | [Mod] PHH Fold Change |
|---|---|---|---|
| 1869 | 0.002028 | 0.002049 | 0.630945 |
| 1870 | 0.002011 | 0.002052 | 1.044067 |
| 1871 | 0.002039 | 0.002032 | 0.858321 |
| 1872 | 0.002073 | 0.002103 | 0.894575 |
| 1874 | 0.00194 | 0.002077 | 0.741909 |
| 1876 | 0.002012 | 0.002203 | 0.77563 |
| 1877 | 0.002166 | 0.00293 | 0.909265 |
| 1878 | 0.002203 | 0.003175 | 0.764486 |
| 1879 | 0.002076 | 0.002159 | 0.870865 |
| 1880 | 0.002123 | 0.00211 | 0.974287 |
| 1882 | 0.001971 | 0.00206 | 1.194054 |
| 1883 | 0.001965 | 0.00198 | 0.850391 |
| 1884 | 0.001983 | 0.00208 | 0.739432 |
| 1885 | 0.004432 | 0.006831 | 0.921387 |
| 1886 | 0.001964 | 0.002047 | 0.905673 |
| 1887 | 0.002128 | 0.002131 | 0.970315 |
| 1888 | 0.00216 | 0.002141 | 0.900712 |
| 1889 | 0.001985 | 0.00209 | 0.904929 |
| 1890 | 0.002027 | 0.002135 | 0.942252 |
| 1891 | 0.001943 | 0.002032 | 1.031348 |
| 1892 | 0.001968 | 0.002051 | 0.673121 |
| 1894 | 0.002064 | 0.002078 | 1.215602 |
| 1895 | 0.002657 | 0.002895 | 0.952559 |
| 1897 | 0.004208 | 0.004197 | 0.877243 |
| 1898 | 0.001943 | 0.002098 | 0.720743 |
| 1899 | 0.001911 | 0.002064 | 0.771716 |
| 1900 | 0.001992 | 0.002012 | 1.042259 |
| 1902 | 0.002111 | 0.002087 | 0.877153 |
| 1903 | 0.002066 | 0.002106 | 1.055068 |
| 1904 | 0.003184 | 0.003144 | 1.09739 |
| 1909 | 0.002055 | 0.003948 | 0.847157 |
| 1912 | 0.00224 | 0.004186 | 0.742941 |
| 1914 | 0.002728 | 0.006378 | 1.015755 |
| 1915 | 0.002104 | 0.003971 | 1.11464 |
| 1916 | 0.002013 | 0.00378 | 0.838864 |
| 1917 | 0.002152 | 0.003877 | 0.908892 |
| 1919 | 0.002163 | 0.003718 | 0.800267 |
| 1921 | 0.002207 | 0.003959 | 0.605339 |
| 1922 | 0.002089 | 0.004028 | 0.664389 |
| 1923 | 0.002035 | 0.003926 | 0.807267 |
| 1924 | 0.002045 | 0.003803 | 0.75616 |
| 1925 | 0.002024 | 0.003787 | 0.78207 |
| 1926 | 0.002081 | 0.004003 | 0.919381 |
| 1927 | 0.002087 | 0.0039 | 0.87094 |
| 1928 | 0.002169 | 0.003842 | 0.85592 |
| 1929 | 0.002196 | 0.003892 | 1.04674 |
| 1930 | 0.002059 | 0.004072 | 0.758699 |
| 1931 | 0.002018 | 0.003893 | 0.935624 |
| 1932 | 0.00212 | 0.003782 | 0.741426 |
| 1935 | 0.002149 | 0.003827 | 0.781431 |
| 1936 | 0.002114 | 0.003987 | 0.983047 |
| 1939 | 0.002105 | 0.003927 | 1.012539 |
| 1940 | 0.002102 | 0.003894 | 0.972949 |
| 1943 | 0.002208 | 0.003969 | 0.819485 |
| 1944 | 0.002129 | 0.003932 | 0.90291 |
| 1949 | 0.002939 | 0.028633 | 0.702177 |
| 1951 | 0.00213 | 0.003953 | 0.756432 |
| 1954 | 0.002084 | 0.003994 | 0.716999 |
| 1955 | 0.002082 | 0.003928 | 0.924112 |
| 1956 | 0.002151 | 0.004369 | 0.83182 |
| 1959 | 0.002066 | 0.003906 | 0.943132 |
| 1960 | 0.002082 | 0.003897 | 0.845987 |
| 1962 | 0.002068 | 0.004065 | 0.677381 |
| 1964 | 0.002309 | 0.005092 | 0.691221 |
| 1965 | 0.002145 | 0.004599 | 1.02379 |
| 1966 | 0.002096 | 0.003928 | 0.821807 |
| 1967 | 0.002135 | 0.004049 | 0.784332 |
| 1969 | 0.00258 | 0.004963 | 0.869906 |
| 1970 | 0.002402 | 0.005499 | 0.802557 |
| 1971 | 0.003555 | 0.00803 | 0.915366 |
| 1972 | 0.002123 | 0.004341 | 1.002436 |
| 1973 | 0.002093 | 0.004195 | 0.739287 |
| 1974 | 0.002264 | 0.004213 | 1.090771 |
| 1975 | 0.00213 | 0.004172 | 0.890328 |
| 1976 | 0.002854 | 0.00629 | 1.03609 |
| 1977 | 0.0022 | 0.003857 | 0.750837 |
| 1978 | 0.002184 | 0.006424 | 0.789674 |
| 1979 | 0.00218 | 0.004072 | 1.041609 |
| 1980 | 0.002089 | 0.003918 | 0.742203 |
| 1981 | 0.002022 | 0.00393 | 0.802623 |
| 1983 | 0.00211 | 0.00387 | 0.823111 |
| 1985 | 0.00238 | 0.005063 | 0.920921 |
| 1987 | 0.002096 | 0.003989 | 0.820149 |
| 1988 | 0.002196 | 0.004207 | 0.733845 |
| 1993 | 0.002629 | 0.004548 | 0.923992 |
| 1994 | 0.003546 | 0.013836 | 0.780026 |
| 1996 | 0.00246 | 0.004831 | 0.793669 |
| 1998 | 0.005897 | 0.010175 | 0.864774 |
| 1999 | 0.002493 | 0.004889 | 0.91103 |
| 2001 | 0.003035 | 0.009213 | 0.760895 |
| 2004 | 0.009008 | 0.051959 | 0.315777 |
| 2006 | 0.007683 | 0.047495 | 0.479879 |
| 2007 | 0.00815 | 0.046714 | 0.350549 |
| 2009 | 0.007773 | 0.047424 | 0.356192 |
| 2010 | 0.008014 | 0.048727 | 0.376383 |
| 2011 | 0.007678 | 0.050682 | 0.388038 |
| 2012 | 0.007658 | 0.048585 | 0.40471 |
| 2013 | 0.00776 | 0.046273 | 0.269896 |
| 2014 | 0.007967 | 0.048251 | 0.353403 |
| 2015 | 0.008137 | 0.046658 | 0.338498 |
| 2016 | 0.007733 | 0.04596 | 0.356733 |
| 2017 | 0.007571 | 0.045682 | 0.396185 |
| 2018 | 0.007836 | 0.047143 | 0.396857 |
| 2019 | 0.008556 | 0.049704 | 0.356688 |
| 2020 | 0.007647 | 0.047487 | 0.406455 |
| 2021 | 0.007659 | 0.046888 | 0.36344 |
| 2022 | 0.007575 | 0.046464 | 0.411014 |
| 2023 | 0.008 | 0.046656 | 0.392491 |
| 2024 | 0.007671 | 0.046704 | 0.343154 |
| 2026 | 0.008452 | 0.049376 | 0.408859 |
| 2027 | 0.007698 | 0.046912 | 0.328525 |
| 2028 | 0.007683 | 0.046616 | 0.339399 |
| 2029 | 0.007666 | 0.046757 | 0.297973 |
| 2030 | 0.007675 | 0.046508 | 0.435685 |
| 2031 | 0.008134 | 0.04519 | 0.411958 |
| 2032 | 0.007675 | 0.045703 | 0.307964 |
| 2033 | 0.007603 | 0.046911 | 0.368773 |
| 2034 | 0.007487 | 0.046125 | 0.42095 |
| 2035 | 0.007824 | 0.048172 | 0.297846 |
| 2036 | 0.007336 | 0.048153 | 0.42074 |
| 2037 | 0.008092 | 0.047712 | 0.309579 |
| 2038 | 0.007771 | 0.046713 | 0.372379 |
| 2039 | 0.008147 | 0.047807 | 0.46323 |
| 2041 | 0.007752 | 0.046575 | 0.519016 |
| 2042 | 0.007808 | 0.047418 | 0.427933 |
| 2043 | 0.007841 | 0.048971 | 0.487233 |
| 2044 | 0.007751 | 0.04791 | 0.502666 |
| 2045 | 0.007997 | 0.04765 | 0.425789 |
| 2046 | 0.007681 | 0.047159 | 0.387429 |
| 2047 | 0.008297 | 0.04738 | 0.434821 |
| 2048 | 0.00876 | 0.04945 | 0.444633 |
| 2049 | 0.007392 | 0.046997 | 0.359452 |
| 2050 | 0.008459 | 0.051214 | 0.257893 |
| 2051 | 0.007739 | 0.048823 | 0.379033 |
| 2052 | 0.007651 | 0.047708 | 0.301475 |
| 2055 | 0.008096 | 0.046365 | 0.286331 |
| 2056 | 0.007633 | 0.045501 | 0.321644 |
| 2057 | 0.007723 | 0.04781 | 0.286926 |
| 2058 | 0.007596 | 0.047326 | 0.35697 |
| 2059 | 0.007819 | 0.048191 | 0.328469 |
| 2060 | 0.007522 | 0.049484 | 0.346836 |
| 2062 | 0.007728 | 0.04874 | 0.437359 |
| 2064 | 0.007614 | 0.047857 | 0.346887 |
| 2065 | 0.007718 | 0.04734 | 0.320753 |
| 2066 | 0.007861 | 0.048273 | 0.33439 |
| 2067 | 0.007787 | 0.048374 | 0.360579 |

TABLE 27-continued

Expression and functional stability screening of IRES

| SEQ ID NO | [Mod] Fold Change Myo | [Mod] T Fold Change | [Mod] PHH Fold Change |
|---|---|---|---|
| 2068 | 0.007899 | 0.047923 | 0.438593 |
| 2069 | 0.007997 | 0.047566 | 0.294398 |
| 2070 | 0.007618 | 0.047015 | 0.368413 |
| 2071 | 0.008211 | 0.047051 | 0.398477 |
| 2072 | 0.007816 | 0.045952 | 0.291645 |
| 2073 | 0.00744 | 0.047558 | 0.416445 |
| 2074 | 0.007748 | 0.047678 | 0.31422 |
| 2075 | 0.007821 | 0.049202 | 0.410995 |
| 2076 | 0.007579 | 0.048504 | 0.35862 |
| 2077 | 0.007606 | 0.048341 | 0.336701 |
| 2078 | 0.007833 | 0.047621 | 0.430521 |
| 2079 | 0.008881 | 0.04708 | 0.367176 |
| 2080 | 0.007632 | 0.046431 | 0.401737 |
| 2081 | 0.007585 | 0.047886 | 0.328978 |
| 2082 | 0.00782 | 0.048005 | 0.42346 |
| 2084 | 0.007872 | 0.048572 | 0.374299 |
| 2085 | 0.007508 | 0.048884 | 0.363426 |
| 2086 | 0.007641 | 0.04778 | 0.455748 |
| 2087 | 0.007576 | 0.046705 | 0.394438 |
| 2089 | 0.007588 | 0.050455 | 0.512216 |
| 2091 | 0.007914 | 0.049272 | 0.348157 |
| 2092 | 0.008757 | 0.085812 | 0.387008 |
| 2093 | 0.007033 | 0.04869 | 0.543809 |
| 2094 | 0.007412 | 0.048193 | 0.462981 |
| 2095 | 0.007785 | 0.048394 | 0.378497 |
| 2096 | 0.00808 | 0.04793 | 0.422319 |
| 2097 | 0.007585 | 0.052485 | 0.339995 |
| 2098 | 0.007722 | 0.077927 | 0.360082 |
| 2101 | 0.003196 | 0.02074 | 0.711343 |
| 2102 | 0.003171 | 0.019613 | 0.932187 |
| 2103 | 0.003015 | 0.019345 | 0.66012 |
| 2105 | 0.003183 | 0.019557 | 0.922989 |
| 2106 | 0.00304 | 0.019249 | 0.610898 |
| 2107 | 0.003086 | 0.020481 | 0.726218 |
| 2108 | 0.003083 | 0.01979 | 0.699435 |
| 2109 | 0.003083 | 0.019528 | 0.595743 |
| 2110 | 0.003043 | 0.01985 | 0.811218 |
| 2111 | 0.003105 | 0.019319 | 0.486517 |
| 2112 | 0.003041 | 0.018937 | 0.51889 |
| 2113 | 0.00304 | 0.019069 | 0.468082 |
| 2114 | 0.003108 | 0.018998 | 0.482694 |
| 2115 | 0.00313 | 0.019507 | 0.554585 |
| 2116 | 0.003166 | 0.020002 | 0.7362 |
| 2118 | 0.003188 | 0.01935 | 0.596176 |
| 2119 | 0.003134 | 0.019993 | 0.637627 |
| 2120 | 0.003081 | 0.019437 | 0.678214 |
| 2121 | 0.003146 | 0.019336 | 0.60839 |
| 2122 | 0.003065 | 0.019235 | 0.499429 |
| 2124 | 0.003203 | 0.019847 | 0.557828 |
| 2125 | 0.003239 | 0.02001 | 0.552858 |
| 2126 | 0.003195 | 0.019259 | 0.656 |
| 2127 | 0.003154 | 0.019186 | 0.483088 |
| 2129 | 0.003119 | 0.019051 | 0.620213 |
| 2130 | 0.003123 | 0.019615 | 0.424395 |
| 2134 | 0.003217 | 0.019331 | 0.536501 |
| 2135 | 0.003065 | 0.019226 | 0.52152 |
| 2137 | 0.003178 | 0.018652 | 0.698231 |
| 2138 | 0.003168 | 0.019197 | 0.587975 |
| 2140 | 0.003216 | 0.019528 | 0.625389 |
| 2141 | 0.00316 | 0.019709 | 0.682383 |
| 2142 | 0.003241 | 0.019746 | 0.516585 |
| 2143 | 0.00322 | 0.019625 | 0.613552 |
| 2144 | 0.003175 | 0.018746 | 0.700146 |
| 2145 | 0.003151 | 0.019352 | 0.390091 |
| 2146 | 0.003246 | 0.019676 | 0.504855 |
| 2147 | 0.00315 | 0.018806 | 0.691577 |
| 2148 | 0.00327 | 0.020065 | 0.647184 |
| 2149 | 0.003318 | 0.019742 | 0.593045 |
| 2150 | 0.003295 | 0.019112 | 0.545147 |
| 2151 | 0.003222 | 0.019324 | 0.623487 |
| 2153 | 0.003163 | 0.019031 | 0.622529 |
| 2154 | 0.003097 | 0.019212 | 0.412396 |
| 2155 | 0.003183 | 0.018864 | 0.628595 |
| 2157 | 0.003208 | 0.019445 | 0.512846 |
| 2158 | 0.00328 | 0.020175 | 0.608198 |
| 2159 | 0.00605 | 0.027206 | 0.523008 |
| 2160 | 0.003294 | 0.019204 | 0.60676 |
| 2161 | 0.003175 | 0.019186 | 0.58493 |
| 2162 | 0.003073 | 0.018774 | 0.676172 |
| 2163 | 0.003213 | 0.026017 | 0.717037 |
| 2164 | 0.003146 | 0.019228 | 0.629069 |
| 2165 | 0.003177 | 0.019712 | 0.651398 |
| 2166 | 0.015226 | 0.067595 | 0.77104 |
| 2168 | 0.003259 | 0.019199 | 0.709717 |
| 2169 | 0.003096 | 0.019088 | 0.552215 |
| 2170 | 0.003193 | 0.019073 | 0.843088 |
| 2171 | 0.003203 | 0.018715 | 0.663203 |
| 2173 | 0.003078 | 0.018872 | 0.596725 |
| 2174 | 0.003215 | 0.019295 | 0.586757 |
| 2175 | 0.003355 | 0.020379 | 0.591717 |
| 2176 | 0.00331 | 0.020075 | 0.621581 |
| 2178 | 0.003288 | 0.019762 | 0.563754 |
| 2179 | 0.023311 | 0.108889 | 0.634632 |
| 2180 | 0.003154 | 0.018821 | 0.582331 |
| 2181 | 0.003174 | 0.019114 | 0.467664 |
| 2182 | 0.003295 | 0.019446 | 0.780908 |
| 2183 | 0.003253 | 0.01977 | 0.567795 |
| 2184 | 0.003242 | 0.020002 | 0.791142 |
| 2185 | 0.003168 | 0.019575 | 0.775637 |
| 2186 | 0.003096 | 0.018948 | 0.568767 |
| 2187 | 0.003259 | 0.019195 | 0.523207 |
| 2188 | 0.003153 | 0.019022 | 0.565014 |
| 2189 | 0.003154 | 0.019989 | 0.535538 |
| 2190 | 0.003524 | 0.019646 | 0.64781 |
| 2191 | 0.004391 | 0.020707 | 0.675903 |
| 2192 | 0.00296 | 0.020679 | 0.695385 |
| 2193 | 0.00312 | 0.019868 | 0.56865 |
| 2194 | 0.003186 | 0.020148 | 0.67523 |
| 2195 | 0.003131 | 0.019043 | 0.529032 |
| 2196 | 0.003166 | 0.020125 | 0.702299 |
| 2197 | 0.003391 | 0.019802 | 0.716997 |
| 2198 | 0.007135 | 0.025543 | 0.647545 |
| 2200 | 0.006172 | 0.047972 | 0.218144 |
| 2201 | 0.006242 | 0.04465 | 0.132477 |
| 2202 | 0.00613 | 0.045688 | 0.181752 |
| 2203 | 0.006068 | 0.046964 | 0.152828 |
| 2204 | 0.005921 | 0.046084 | 0.14141 |
| 2205 | 0.006157 | 0.046238 | 0.191263 |
| 2206 | 0.006136 | 0.046016 | 0.190921 |
| 2207 | 0.005964 | 0.047186 | 0.153246 |
| 2208 | 0.006177 | 0.047117 | 0.155879 |
| 2210 | 0.006352 | 0.043635 | 0.146858 |
| 2211 | 0.006108 | 0.044772 | 0.155641 |
| 2212 | 0.006024 | 0.045543 | 0.142517 |
| 2213 | 0.005939 | 0.046344 | 0.143164 |
| 2214 | 0.006222 | 0.04614 | 0.192484 |
| 2215 | 0.006083 | 0.047678 | 0.16743 |
| 2216 | 0.006163 | 0.053998 | 0.13437 |
| 2217 | 0.006135 | 0.045467 | 0.137485 |
| 2218 | 0.006112 | 0.046402 | 0.156384 |
| 2219 | 0.006181 | 0.046612 | 0.162334 |
| 2220 | 0.006096 | 0.050543 | 0.162733 |
| 2221 | 0.006186 | 0.047334 | 0.152158 |
| 2222 | 0.006075 | 0.047502 | 0.194765 |
| 2223 | 0.006029 | 0.046467 | 0.137691 |
| 2224 | 0.006314 | 0.055065 | 0.20807 |
| 2226 | 0.006294 | 0.045913 | 0.209723 |
| 2227 | 0.006684 | 0.046979 | 0.190792 |
| 2228 | 0.006095 | 0.04607 | 0.165137 |
| 2229 | 0.006403 | 0.052747 | 0.16783 |
| 2231 | 0.006318 | 0.047325 | 0.120074 |
| 2232 | 0.006136 | 0.047645 | 0.154048 |
| 2233 | 0.008079 | 0.057783 | 0.168608 |
| 2234 | 0.006343 | 0.048289 | 0.130913 |
| 2238 | 0.006235 | 0.046307 | 0.168547 |
| 2239 | 0.006246 | 0.046488 | 0.140553 |

TABLE 27-continued

Expression and functional stability screening of IRES

| SEQ ID NO | [Mod] Fold Change Myo | [Mod] T Fold Change | [Mod] PHH Fold Change |
|---|---|---|---|
| 2241 | 0.006379 | 0.054148 | 0.24124 |
| 2242 | 0.006455 | 0.047961 | 0.131922 |
| 2243 | 0.006337 | 0.046456 | 0.186051 |
| 2244 | 0.006203 | 0.045602 | 0.125512 |
| 2245 | 0.006499 | 0.057369 | 0.154019 |
| 2246 | 0.006248 | 0.056398 | 0.149261 |
| 2247 | 0.006307 | 0.046397 | 0.228139 |
| 2248 | 0.006168 | 0.047874 | 0.112137 |
| 2249 | 0.006196 | 0.046805 | 0.155686 |
| 2250 | 0.00895 | 0.054401 | 0.183022 |
| 2251 | 0.00639 | 0.045554 | 0.169424 |
| 2252 | 0.006125 | 0.046755 | 0.150411 |
| 2253 | 0.00622 | 0.053633 | 0.191924 |
| 2254 | 0.006108 | 0.046631 | 0.13209 |
| 2255 | 0.00633 | 0.04723 | 0.135853 |
| 2256 | 0.006144 | 0.061456 | 0.112837 |
| 2257 | 0.006404 | 0.047664 | 0.179404 |
| 2258 | 0.00629 | 0.04559 | 0.115119 |
| 2259 | 0.006517 | 0.047495 | 0.139756 |
| 2260 | 0.006178 | 0.046241 | 0.166521 |
| 2261 | 0.006256 | 0.047309 | 0.21795 |
| 2262 | 0.006307 | 0.046961 | 0.155011 |
| 2263 | 0.006309 | 0.046877 | 0.215311 |
| 2264 | 0.00632 | 0.047891 | 0.153035 |
| 2265 | 0.006283 | 0.058641 | 0.211202 |
| 2266 | 0.006381 | 0.047328 | 0.134896 |
| 2267 | 0.006567 | 0.045783 | 0.135634 |
| 2269 | 0.006447 | 0.046908 | 0.133405 |
| 2270 | 0.006417 | 0.04824 | 0.139725 |
| 2271 | 0.00618 | 0.046553 | 0.166047 |
| 2272 | 0.006225 | 0.047393 | 0.160067 |
| 2273 | 0.006276 | 0.047685 | 0.170297 |
| 2274 | 0.00624 | 0.04688 | 0.198238 |
| 2275 | 0.006534 | 0.046315 | 0.157348 |
| 2276 | 0.007069 | 0.047997 | 0.152782 |
| 2277 | 0.009026 | 0.05061 | 0.196609 |
| 2278 | 0.014832 | 0.067865 | 0.14616 |
| 2279 | 0.006428 | 0.046196 | 0.131052 |
| 2280 | 0.006224 | 0.046989 | 0.145311 |
| 2281 | 0.006154 | 0.047328 | 0.14968 |
| 2282 | 0.006248 | 0.046031 | 0.150055 |
| 2283 | 0.006174 | 0.047343 | 0.163964 |
| 2284 | 0.008235 | 0.4302 | 0.20482 |
| 2285 | 1.795726 | 2.705619 | 0.273225 |
| 2286 | 0.008775 | 0.050342 | 0.1587 |
| 2287 | 0.00631 | 0.047599 | 0.134257 |
| 2288 | 0.006544 | 0.046959 | 0.161388 |
| 2289 | 0.008183 | 0.050593 | 0.141202 |
| 2290 | 0.006064 | 0.048815 | 0.175503 |
| 2291 | 0.00618 | 0.046271 | 0.152712 |
| 2292 | 0.007016 | 0.048265 | 0.181027 |
| 2293 | 0.008176 | 0.049316 | 0.164933 |
| 2294 | 0.006486 | 0.048746 | 0.152462 |
| 2295 | 0.006359 | 0.047944 | 0.131901 |
| 2296 | 0.00722 | 0.04902 | 0.134938 |
| 2299 | 0.001841 | 0.021836 | 0.688111 |
| 2300 | 0.086641 | 0.166328 | 0.690494 |
| 2301 | 0.001849 | 0.020911 | 0.564046 |
| 2302 | 0.001837 | 0.020036 | 0.674931 |
| 2303 | 0.001843 | 0.020641 | 0.808588 |
| 2304 | 0.001836 | 0.020295 | 0.58194 |
| 2305 | 0.001822 | 0.020215 | 0.654307 |
| 2306 | 0.002438 | 0.022581 | 0.736907 |
| 2307 | 0.00178 | 0.021066 | 0.620358 |
| 2308 | 0.001832 | 0.020095 | 0.668554 |
| 2309 | 0.00178 | 0.019898 | 0.763666 |
| 2310 | 0.003472 | 0.020626 | 0.667713 |
| 2311 | 0.001796 | 0.019725 | 0.588065 |
| 2312 | 0.001799 | 0.020161 | 0.680887 |
| 2313 | 0.001785 | 0.020109 | 0.751756 |
| 2314 | 0.001785 | 0.020767 | 0.734117 |
| 2315 | 0.001731 | 0.021027 | 0.575685 |
| 2316 | 0.001777 | 0.020545 | 0.621465 |
| 2317 | 0.001726 | 0.020462 | 0.635235 |
| 2319 | 0.001783 | 0.019558 | 0.623992 |
| 2320 | 0.001783 | 0.019848 | 0.456169 |
| 2321 | 0.001819 | 0.019947 | 0.557319 |
| 2322 | 0.001816 | 0.020314 | 0.849308 |
| 2323 | 0.001812 | 0.021185 | 0.5437 |
| 2324 | 0.002117 | 0.021167 | 0.623834 |
| 2325 | 0.001774 | 0.020086 | 0.705615 |
| 2326 | 0.001762 | 0.020397 | 0.609166 |
| 2327 | 0.001838 | 0.019555 | 0.516895 |
| 2328 | 0.001819 | 0.019407 | 0.566088 |
| 2329 | 0.001846 | 0.020255 | 0.675583 |
| 2330 | 0.001822 | 0.020372 | 0.658319 |
| 2331 | 0.00183 | 0.020907 | 0.712729 |
| 2332 | 0.001716 | 0.020645 | 0.633101 |
| 2333 | 0.001761 | 0.020053 | 0.496843 |
| 2334 | 0.001795 | 0.020116 | 0.470328 |
| 2335 | 0.001973 | 0.019994 | 0.69908 |
| 2336 | 0.002355 | 0.021316 | 0.639826 |
| 2337 | 0.002071 | 0.019995 | 0.717695 |
| 2338 | 0.003361 | 0.022952 | 0.608106 |
| 2339 | 0.002512 | 0.022295 | 0.934816 |
| 2340 | 0.001872 | 0.02124 | 0.653365 |
| 2341 | 0.001758 | 0.020188 | 0.628362 |
| 2342 | 0.00179 | 0.020031 | 0.430364 |
| 2343 | 0.00225 | 0.021727 | 0.620708 |
| 2344 | 0.487092 | 1.242389 | 0.705218 |
| 2346 | 0.62511 | 0.991799 | 0.755326 |
| 2347 | 0.007601 | 0.031311 | 0.516649 |
| 2348 | 0.003801 | 0.024391 | 0.44802 |
| 2349 | 0.001763 | 0.020418 | 0.710152 |
| 2352 | 0.001967 | 0.020354 | 0.674644 |
| 2353 | 0.002343 | 0.020885 | 0.451139 |
| 2354 | 0.005892 | 0.03064 | 0.7194 |
| 2355 | 0.002628 | 0.021243 | 0.487594 |
| 2356 | 0.002016 | 0.021037 | 0.615679 |
| 2357 | 0.002143 | 0.021701 | 0.386956 |
| 2358 | 0.00212 | 0.021198 | 0.829166 |
| 2359 | 0.001791 | 0.020172 | 0.544619 |
| 2360 | 0.001856 | 0.020163 | 0.486583 |
| 2361 | 0.001901 | 0.019958 | 0.530139 |
| 2362 | 0.001879 | 0.020308 | 0.653006 |
| 2363 | 0.001922 | 0.020067 | 0.590144 |
| 2364 | 0.001837 | 0.02092 | 0.592571 |
| 2365 | 0.001792 | 0.020929 | 0.551517 |
| 2366 | 0.001791 | 0.020276 | 0.562391 |
| 2367 | 0.001762 | 0.020237 | 0.490932 |
| 2368 | 0.001774 | 0.019958 | 0.581639 |
| 2369 | 0.002441 | 0.023886 | 0.442913 |
| 2370 | 0.001851 | 0.019744 | 0.597586 |
| 2371 | 0.001833 | 0.019874 | 0.780994 |
| 2372 | 0.001836 | 0.020828 | 0.624654 |
| 2373 | 0.002203 | 0.0221 | 0.648313 |
| 2374 | 0.001781 | 0.02029 | 0.477161 |
| 2375 | 0.001758 | 0.019773 | 0.487119 |
| 2376 | 0.001766 | 0.019771 | 0.526721 |
| 2377 | 0.001848 | 0.019724 | 0.617253 |
| 2379 | 0.001845 | 0.020022 | 0.490031 |
| 2380 | 0.001881 | 0.020903 | 0.584369 |
| 2381 | 0.329765 | 0.386006 | 0.504277 |
| 2382 | 0.002171 | 0.020794 | 0.601362 |
| 2383 | 0.001822 | 0.020056 | 0.529306 |
| 2384 | 0.001781 | 0.019899 | 0.518998 |
| 2385 | 0.002162 | 0.020271 | 0.525008 |
| 2386 | 0.001834 | 0.019886 | 0.548855 |
| 2387 | 0.002131 | 0.020496 | 0.494099 |
| 2388 | 0.002937 | 0.022063 | 0.622276 |
| 2390 | 0.001843 | 0.021049 | 0.592485 |
| 2392 | 0.001773 | 0.020597 | 0.495091 |
| 2394 | 0.001773 | 0.020237 | 0.601764 |
| 2395 | 0.001806 | 0.020086 | 0.558798 |
| 2396 | 0.001807 | 0.02021 | 0.456341 |
| 2397 | 0.002983 | 0.022137 | 0.664263 |

TABLE 27-continued

Expression and functional stability screening of IRES

| SEQ ID NO | [Mod] Fold Change Myo | [Mod] T Fold Change | [Mod] PHH Fold Change |
|---|---|---|---|
| 2399 | 0.002032 | 0.028561 | 0.419347 |
| 2400 | 0.001953 | 0.02732 | 0.539873 |
| 2401 | 0.001912 | 0.027274 | 0.638418 |
| 2402 | 0.001914 | 0.026898 | 0.523509 |
| 2403 | 0.001954 | 0.027389 | 0.678695 |
| 2404 | 0.001977 | 0.027124 | 0.765805 |
| 2405 | 0.00211 | 0.030541 | 0.701647 |
| 2406 | 0.00247 | 0.029078 | 0.813564 |
| 2407 | 0.002076 | 0.027414 | 0.698683 |
| 2408 | 0.001925 | 0.028973 | 0.656613 |
| 2409 | 0.002188 | 0.027465 | 0.541032 |
| 2410 | 0.001926 | 0.025909 | 0.545951 |
| 2411 | 0.00194 | 0.026781 | 0.754864 |
| 2412 | 0.00382 | 0.039591 | 0.762652 |
| 2413 | 0.002162 | 0.027084 | 0.685745 |
| 2414 | 0.002494 | 0.029168 | 0.594618 |
| 2415 | 0.002268 | 0.029022 | 0.768169 |
| 2416 | 0.001922 | 0.026555 | 0.470209 |
| 2417 | 0.002127 | 0.027122 | 0.636734 |
| 2418 | 0.001951 | 0.026994 | 0.650385 |
| 2419 | 0.001945 | 0.027143 | 0.883213 |
| 2420 | 0.002209 | 0.02794 | 0.572425 |
| 2421 | 0.003578 | 0.031521 | 0.65348 |
| 2422 | 0.4597 | 1.118984 | 0.742345 |
| 2423 | 0.002036 | 0.027481 | 0.594989 |
| 2424 | 0.001912 | 0.026795 | 0.566853 |
| 2425 | 0.002128 | 0.027336 | 0.616199 |
| 2426 | 0.004274 | 0.035029 | 0.701308 |
| 2427 | 0.002039 | 0.026637 | 0.688343 |
| 2428 | 0.002025 | 0.026834 | 0.482521 |
| 2430 | 0.002201 | 0.027234 | 0.454862 |
| 2431 | 0.002645 | 0.028863 | 0.606143 |
| 2432 | 0.002137 | 0.027883 | 0.73667 |
| 2433 | 0.001911 | 0.026777 | 0.764379 |
| 2434 | 0.002656 | 0.031144 | 0.654025 |
| 2435 | 0.357958 | 1.054187 | 0.789014 |
| 2436 | 0.002408 | 0.027834 | 0.652141 |
| 2437 | 0.002128 | 0.029482 | 0.589591 |
| 2438 | 0.002046 | 0.027328 | 0.6305 |
| 2439 | 0.002126 | 0.027527 | 0.702897 |
| 2441 | 0.001931 | 0.027353 | 0.554509 |
| 2442 | 0.00194 | 0.026835 | 0.748374 |
| 2443 | 0.00206 | 0.027504 | 0.580563 |
| 2444 | 0.002454 | 0.030028 | 0.562538 |
| 2445 | 0.002479 | 0.027979 | 0.691218 |
| 2446 | 0.002005 | 0.026464 | 0.592756 |
| 2447 | 0.00209 | 0.02736 | 0.67768 |
| 2448 | 0.00215 | 0.027489 | 0.746934 |
| 2449 | 0.001919 | 0.027314 | 0.63539 |
| 2450 | 0.001947 | 0.026788 | 0.971937 |
| 2451 | 0.002047 | 0.027081 | 0.714018 |
| 2452 | 0.00199 | 0.026765 | 0.687724 |
| 2453 | 0.002001 | 0.026884 | 0.675106 |
| 2454 | 0.002043 | 0.026814 | 0.578459 |
| 2455 | 0.002485 | 0.027898 | 0.62214 |
| 2456 | 0.003114 | 0.03194 | 0.536157 |
| 2457 | 0.002044 | 0.028064 | 0.672813 |
| 2458 | 0.015881 | 0.100316 | 0.627601 |
| 2460 | 0.00195 | 0.026811 | 0.61264 |
| 2461 | 0.001936 | 0.027321 | 0.614411 |
| 2462 | 0.001952 | 0.026879 | 0.570422 |
| 2463 | 0.001996 | 0.026846 | 0.724248 |
| 2464 | 0.003014 | 0.029551 | 0.681079 |
| 2465 | 0.851106 | 1.519622 | 0.556387 |
| 2466 | 0.001875 | 0.027585 | 0.573732 |
| 2467 | 0.001914 | 0.026865 | 0.584638 |
| 2468 | 0.001951 | 0.026667 | 0.76513 |
| 2469 | 0.001935 | 0.026646 | 0.483364 |
| 2470 | 0.001927 | 0.027128 | 0.708523 |
| 2471 | 0.002115 | 0.027369 | 0.645251 |
| 2472 | 0.002277 | 0.02739 | 0.83229 |
| 2473 | 0.003074 | 0.029112 | 0.868278 |
| 2474 | 0.001898 | 0.031517 | 0.628315 |
| 2475 | 0.001888 | 0.025737 | 0.488711 |
| 2476 | 0.001895 | 0.026321 | 0.539154 |
| 2477 | 0.001942 | 0.02957 | 0.540224 |
| 2478 | 0.001972 | 0.026698 | 0.560129 |
| 2479 | 0.002055 | 0.026361 | 0.588692 |
| 2480 | 0.002449 | 0.029257 | 0.564031 |
| 2481 | 0.002188 | 0.027339 | 0.617131 |
| 2482 | 0.001929 | 0.027532 | 0.647844 |
| 2483 | 0.001901 | 0.026611 | 0.505461 |
| 2484 | 0.001911 | 0.026331 | 0.632902 |
| 2485 | 0.001935 | 0.026733 | 0.781338 |
| 2486 | 0.00232 | 0.028127 | 0.762296 |
| 2487 | 0.002045 | 0.029716 | 0.555858 |
| 2488 | 0.002322 | 0.027239 | 0.655834 |
| 2489 | 0.003042 | 0.02839 | 0.619313 |
| 2490 | 0.001901 | 0.027794 | 0.675581 |
| 2491 | 0.001867 | 0.026896 | 0.63697 |
| 2492 | 0.001957 | 0.027113 | 0.720652 |
| 2493 | 0.00211 | 0.02692 | 0.928346 |
| 2494 | 0.001976 | 0.02681 | 0.505157 |
| 2496 | 0.005512 | 0.03457 | 0.661025 |
| 2498 | 0.001855 | 0.021094 | 1.26703 |
| 2499 | 0.001794 | 0.019382 | 1.205979 |
| 2500 | 0.001798 | 0.019209 | 1.194211 |
| 2501 | 0.001855 | 0.019647 | 1.175705 |
| 2502 | 0.001805 | 0.01951 | 1.05585 |
| 2503 | 0.001854 | 0.01969 | 0.740211 |
| 2504 | 0.001802 | 0.019108 | 1.169167 |
| 2505 | 0.001803 | 0.020364 | 1.044078 |
| 2507 | 0.001816 | 0.019238 | 0.826173 |
| 2508 | 0.0018 | 0.019457 | 0.747832 |
| 2509 | 0.001814 | 0.018725 | 0.764182 |
| 2510 | 0.001788 | 0.018705 | 0.961773 |
| 2511 | 0.001811 | 0.019187 | 1.002978 |
| 2512 | 0.00184 | 0.019337 | 0.951505 |
| 2513 | 0.001795 | 0.0198 | 0.784969 |
| 2514 | 0.001806 | 0.019423 | 1.155331 |
| 2515 | 0.001819 | 0.019277 | 0.899568 |
| 2516 | 0.001783 | 0.018727 | 0.906725 |
| 2517 | 0.001767 | 0.018491 | 1.156806 |
| 2518 | 0.001826 | 0.018843 | 0.984126 |
| 2519 | 0.001827 | 0.018971 | 1.106655 |
| 2520 | 0.001856 | 0.019129 | 0.981249 |
| 2521 | 0.001863 | 0.019361 | 0.815735 |
| 2522 | 0.001753 | 0.019788 | 0.683346 |
| 2523 | 0.00179 | 0.018958 | 0.763397 |
| 2524 | 0.001774 | 0.019189 | 0.99147 |
| 2525 | 0.001796 | 0.019005 | 1.173316 |
| 2526 | 0.00239 | 0.022053 | 0.703461 |
| 2527 | 0.001839 | 0.018912 | 0.926152 |
| 2528 | 0.002235 | 0.020166 | 0.849943 |
| 2529 | 0.001833 | 0.019542 | 1.169762 |
| 2531 | 0.001757 | 0.019516 | 0.804991 |
| 2532 | 0.001791 | 0.019332 | 0.97138 |
| 2533 | 0.00183 | 0.018744 | 0.932083 |
| 2534 | 0.001829 | 0.018966 | 0.603137 |
| 2535 | 0.001825 | 0.019067 | 0.775401 |
| 2536 | 0.001839 | 0.019239 | 1.005791 |
| 2537 | 0.001837 | 0.019027 | 0.742716 |
| 2538 | 0.00184 | 0.019119 | 1.025351 |
| 2539 | 0.001786 | 0.019252 | 1.038877 |
| 2540 | 0.001818 | 0.019031 | 1.121716 |
| 2541 | 0.001778 | 0.018762 | 0.803414 |
| 2542 | 0.00183 | 0.01897 | 0.935541 |
| 2543 | 0.001856 | 0.018641 | 0.779233 |
| 2544 | 0.001832 | 0.018997 | 0.936523 |
| 2545 | 0.001818 | 0.019351 | 0.785605 |
| 2546 | 0.001855 | 0.019618 | 1.078452 |
| 2547 | 0.001753 | 0.019425 | 0.952274 |
| 2548 | 0.001801 | 0.019016 | 0.883621 |
| 2549 | 0.001932 | 0.019884 | 0.963362 |
| 2550 | 0.001852 | 0.019493 | 0.756811 |
| 2551 | 0.001811 | 0.018994 | 0.735339 |

TABLE 27-continued

Expression and functional stability screening of IRES

| SEQ ID NO | [Mod] Fold Change Myo | [Mod] T Fold Change | [Mod] PHH Fold Change |
|---|---|---|---|
| 2552 | 0.001829 | 0.018641 | 0.751335 |
| 2553 | 0.001842 | 0.019264 | 0.734602 |
| 2555 | 0.001803 | 0.019524 | 0.791215 |
| 2556 | 0.001808 | 0.019326 | 1.234156 |
| 2557 | 0.001817 | 0.019034 | 0.844118 |
| 2559 | 0.0018 | 0.019361 | 0.832718 |
| 2560 | 0.001849 | 0.018958 | 1.108257 |
| 2561 | 0.001875 | 0.019191 | 0.924327 |
| 2562 | 0.00183 | 0.019757 | 0.913942 |
| 2563 | 0.001766 | 0.019449 | 1.039711 |
| 2564 | 0.001761 | 0.019642 | 0.975257 |
| 2565 | 0.001822 | 0.018907 | 0.875283 |
| 2566 | 0.001827 | 0.018953 | 0.804406 |
| 2567 | 0.00182 | 0.01881 | 0.84509 |
| 2568 | 0.001815 | 0.018919 | 0.949194 |
| 2569 | 0.00187 | 0.018963 | 0.839079 |
| 2570 | 0.001859 | 0.019606 | 0.843373 |
| 2571 | 0.001771 | 0.019425 | 0.664874 |
| 2572 | 0.001861 | 0.019316 | 0.807564 |
| 2573 | 0.001825 | 0.018896 | 1.142032 |
| 2574 | 0.001799 | 0.018916 | 0.733867 |
| 2575 | 0.001848 | 0.018948 | 0.764302 |
| 2576 | 0.001862 | 0.0189 | 0.934422 |
| 2578 | 0.001938 | 0.019715 | 0.942217 |
| 2579 | 0.001762 | 0.019242 | 0.986229 |
| 2580 | 0.001771 | 0.01972 | 0.75995 |
| 2581 | 0.001846 | 0.019138 | 0.813534 |
| 2582 | 0.001812 | 0.018893 | 1.03767 |
| 2583 | 0.001829 | 0.019116 | 0.974132 |
| 2584 | 0.001881 | 0.019667 | 0.850391 |
| 2585 | 0.002575 | 0.020133 | 1.050868 |
| 2586 | 0.002919 | 0.020784 | 0.982573 |
| 2587 | 0.001816 | 0.019662 | 0.675518 |
| 2588 | 0.001816 | 0.019437 | 0.754413 |
| 2589 | 0.001844 | 0.01968 | 0.725135 |
| 2590 | 0.00185 | 0.020018 | 0.754455 |
| 2591 | 0.001831 | 0.019558 | 0.900126 |
| 2593 | 0.001894 | 0.019772 | 0.853028 |
| 2594 | 0.003467 | 0.021701 | 0.877 |

Example 94

Expression of CD19-41BBζ, CD19-CD28ζ, HER2-41BBζ, or HER2-CD28ζ Chimeric Antigen Receptors (CARs) Following In Vitro Administration of Circular RNAs Encoding Said CARs Human T cells from three unique T cells donors were activated with anti-CD3 or CD28 for three days and set to rest for 24 hours. Engineered circular RNA (oRNA) encoding CD19-41BBζ, CD19-CD28ζ, HER2-41BBζ, or HER2-CD28ζ chimeric antigen receptors (CARs) were electroporated into the human T cells. 24 hours post transfection CAR expression for each of the CARs were measured using fluorescence-activated cell sorting (FACS).

Figure 102A:
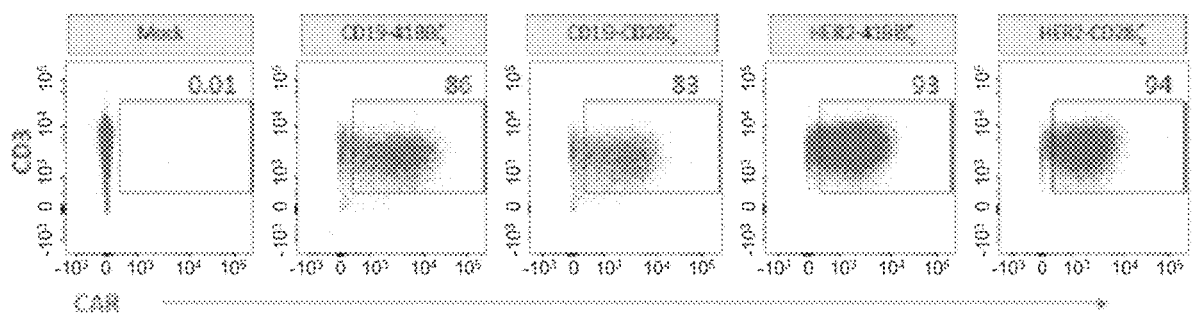
FIG. 102A and FIG. 102B show anti-CD19 CAR expression levels resulting from in vitro delivery via electroporation of various circular RNA encoding chimeric antigen receptors in human T cells.
Figure 102B:
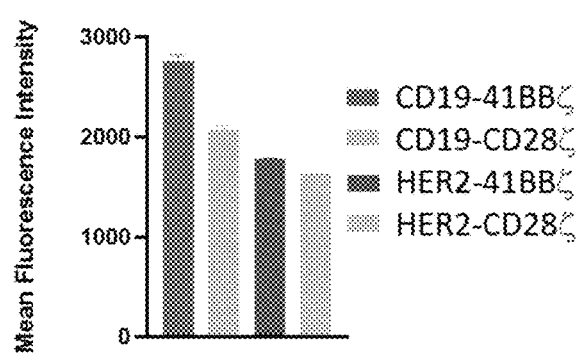

As seen in FIGS. 102A and 102B, the circular RNA constructs were able to express CAR for each of the different CAR constructs.

Example 95

Lysis of Tumor Cells Following In Vitro Transfection of CD19-41BBζ and CD19-CD28ζ Chimeric Antigen Receptors (CARs) and Cytokine Production Human T cells were activated with anti-CD3 or CD28 for three days and rested for 24 hours. The cells were then transfected with circular RNAs encoding for mOX40L (positive control), CD19-41BBζ, CD19-CD28ζ, HER2-41BBζ, or HER2-CD28ζ chimeric antigen receptors (CARs) via electroporation. 24 hours post-electroporation, said T cells were cocultured with Nalm6 tumor cells at a 1:1 effector to target (E:T) ratio. Nalm6 killing was measured 24 hours following coculturing of the human T cells with the Nalm6 tumor cells. Coculture supernatants were collect and analyzed using Meso Scale Discovery (MSD) (Agilent Technologies, Santa Clara, CA) for IFN-g and IL-2 expression.

Figure 103A:
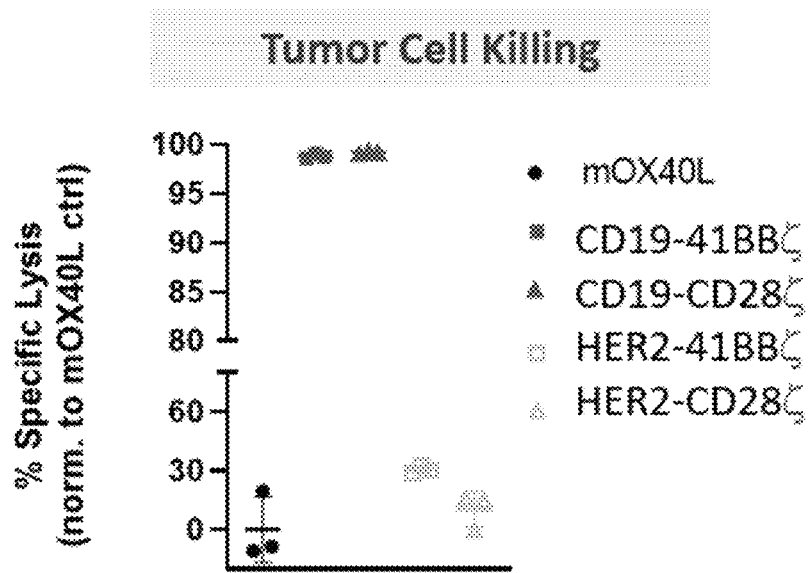
FIGS. 103A-103C illustrate cytotoxic response to tumor cells upon electroporation of T cells with circular RNA encoding CD19-41BBζ and CD19-CD28ζ and subsequent co-culture with tumor cells.
Figure 103B:
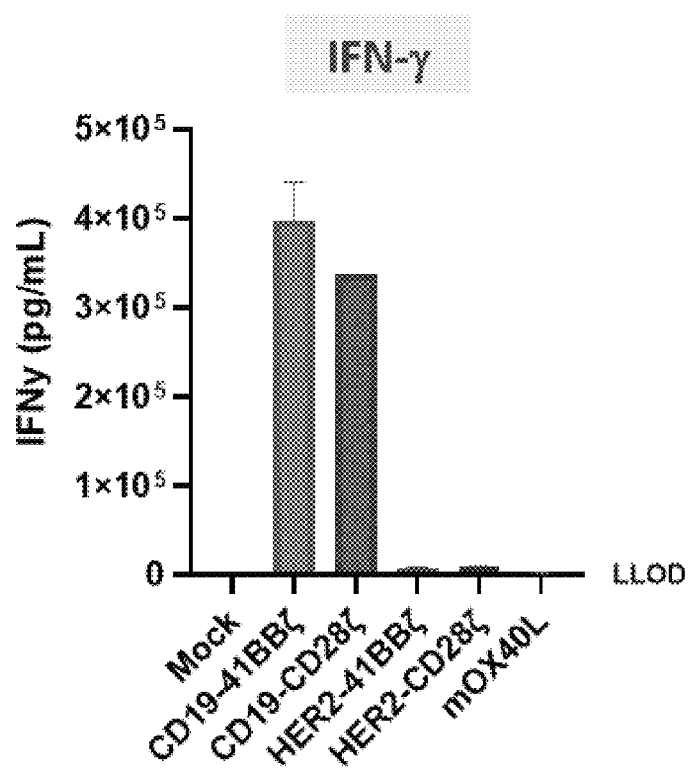
Figure 103C:
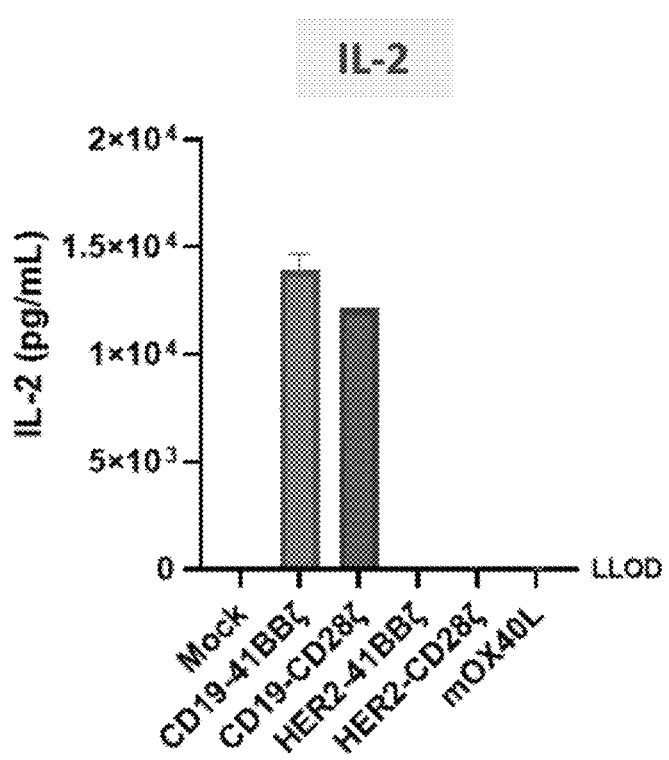

As seen in FIG. 103A, CD19-41BBζ and CD19-CD28ζ encoding circular RNAs surpassed tumor cell killing to the positive control, mOX40L circular RNAs, and even surpassed HER2-41BBζ and HER2-CD28ζ. The circRNAs encoding CD19-BBζ and CD19-28ζ also surpassed the IFN-g and IL-2 cytokine compared to the circRNAs encoding HER2-41BBζ, HER2-CD28ζ, or mOX40L (FIG. 103B and FIG. 103C). Antigen specific killing was observed at 1:3 effector to target (E:T) ratio following transfection of the circRNAs.

Example 96 mOX40L Expression in Blood and Splenic Human T Cells of Humanized Mice Following Intravenous Administration of LNP-circRNA Encoding mOX40L NOG mice (1E7 Mouse Hybridoma) were engrafted with human peripheral blood mononuclear cells (hPBMC). 3 weeks later the mice were treated with a single intravenous dose of LNP encapsulating circular RNAs encoding mOx40L at 2 mg/kg. LNP were formulated with ionizable lipid 10b-15 (Table 10b, Lipid 15), 10a-27 (Table 10a, Lipid 27), or 10a-26 (Table 10a, Lipid 26). 24 hours following intravenous administration, splenocytes and peripheral blood cells were isolated and analyzed for T cell expression of mOX40L.

Figure 104A:
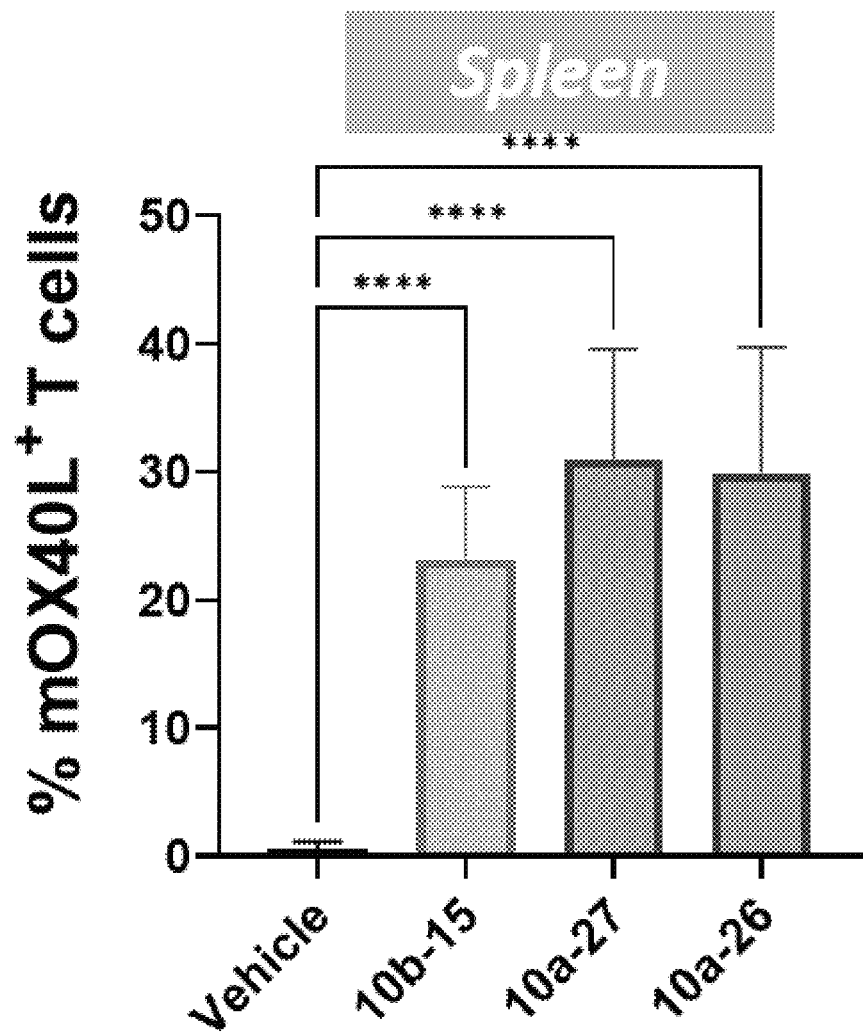
FIG. 104A and FIG. 104B show in vivo mOX40L expression in the splenic and peripheral blood T cells of humanized mice following intravenous administration of LNP formulated with circular RNAs encoding mOX40L. LNPs were formulated with either PBS (indicated as "vehicle" in said figure), or LNP-oRNA constructs formulated with lipid 10b-15 (Table 10b, Lipid 15), 10a-27 (Table 10a, Lipid 27), or 10a-26 (Table 10a, Lipid 26).
Figure 104B:
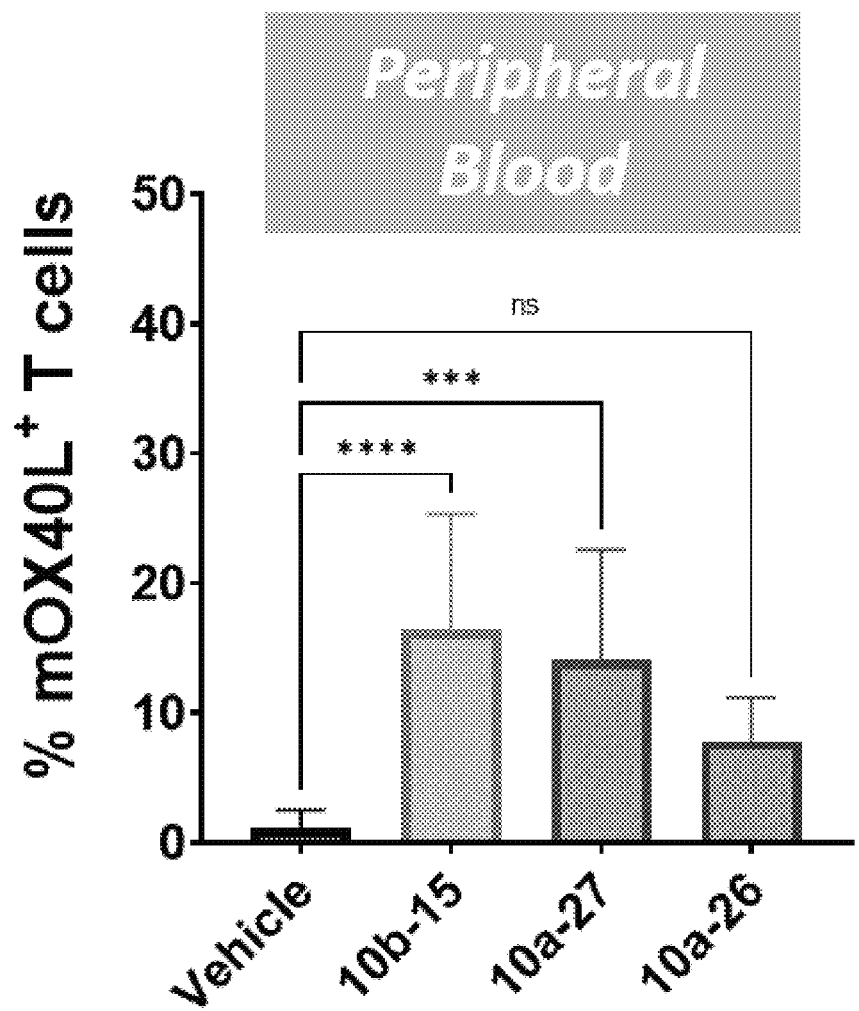

As seen in FIGS. 104A and 104B, mOX40L was detected in the human T cells of the humanized mice's spleen and peripheral blood for each of the LNP constructs. Expression was higher for all three constructs in the spleen.

Example 97

B Cell Aplasia in the Spleen of Humanized Mice Following Intravenous Administration of LNP-circRNA Construct Encoding for an Anti-CD19 CAR NOG mice (1E7 Mouse Hybridoma) were engrafted with human peripheral blood mononuclear cells (hPBMC) at 50-60% human engraftment in total. 3 weeks after engraftment, the mice were treated with a single dose of LNPs encapsulating circular RNA encoding anti-CD19 CAR or 1XPBS (negative control) at 2 mg/kg. Six days post dosing, splenocytes were isolated and analyzed for the presence of B cells via CD19 expression.

Figure 105:
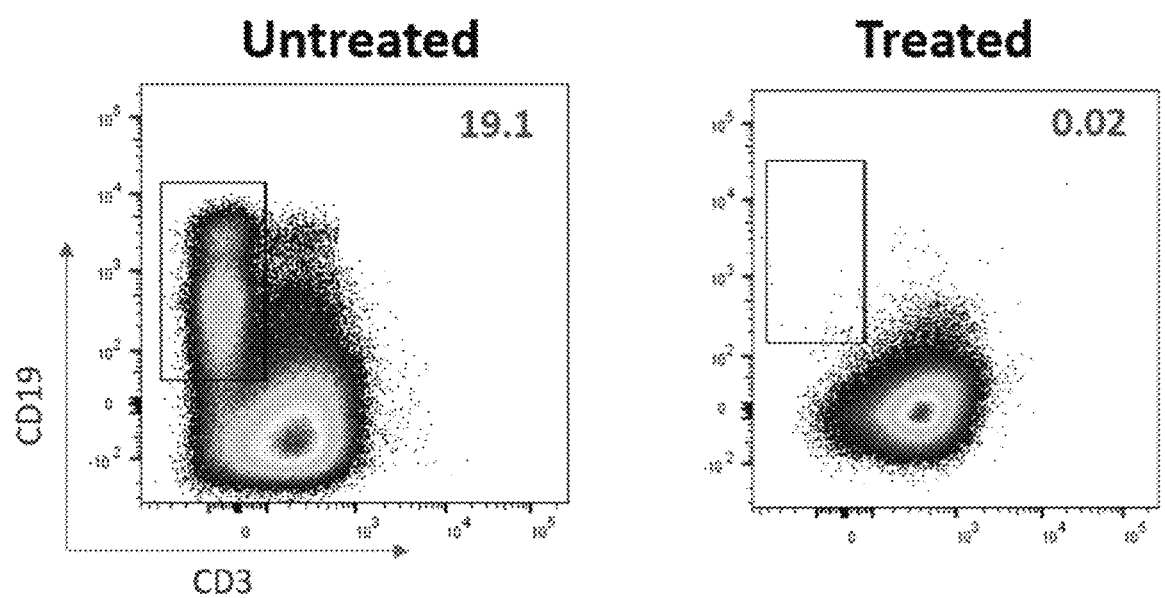
FIG. 105 illustrates B cell aplasia in humanized mice after intravenous administration of LNP formulated with circular RNA encoding anti-CD19 chimeric antigen receptor (CAR). Representative FACS dot plots from the peripheral blood of untreated animals (left) and treated animals (right) show the percentage of B cells post 6 days from intravenous administration.

As seen in FIG. 105, B cell aplasia was present in the humanized mice when comparing the splenocytes of the mice receiving LNP-circRNA constructs (the left of FIG. 105) compared to the splenocytes of the mice receiving the negative control (the right of FIG. 105).

Example 98

Nalm6 Killing Following In Vitro Administration of Circular RNA Constructs Encoding Different CARs T cells were activated with anti-CD3 or anti-CD28 for three days and rested for 24 hours. The cells were then treated with LNP-circRNAs encoding mOX40L (positive control), CD19-41BBζ, CD19-CD28ζ, HER2-41BBζ, or HER2-CD28ζ chimeric antigen receptors (CARs). LNPs were formulated using ionizable lipid 10b-15 (Table 10b, Lipid 15). Expression of the CARs was measured by fluorescence-activated cell sorting (FACS) to measure the mean fluorescence activity (MFI). T cells were then cocultured with Nalm6 tumor cells. Nalm6 killing was measured the following day.

Figure 106A:
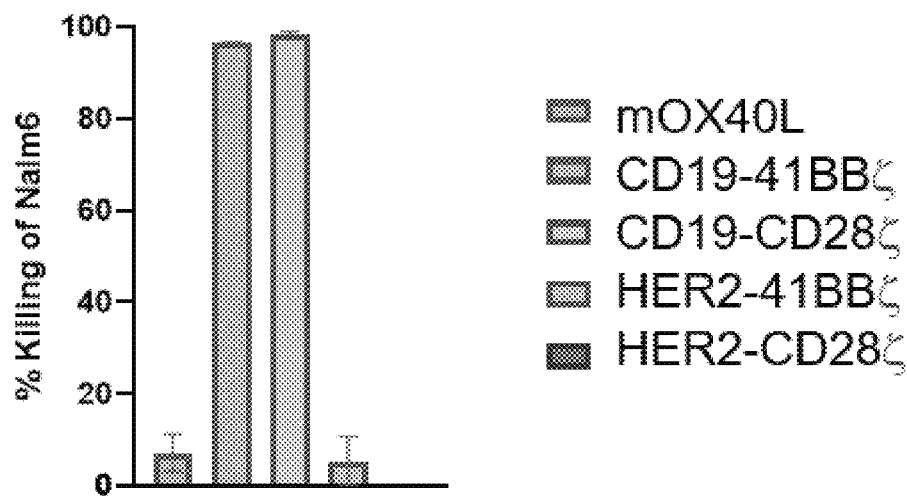
FIG. 106A and FIG. 106B show % killing of Nalm6 tumor cells after co-culture with LNP-oRNA encoding CAR or control (FIG. 106A) and chimeric antigen receptor (CAR) surface expression (FIG. 106B) following in vitro transfection of LNP-circular RNA (oRNA) encoding CD19-41BBζ or CD19-CD28ζ CARs.
Figure 106B:
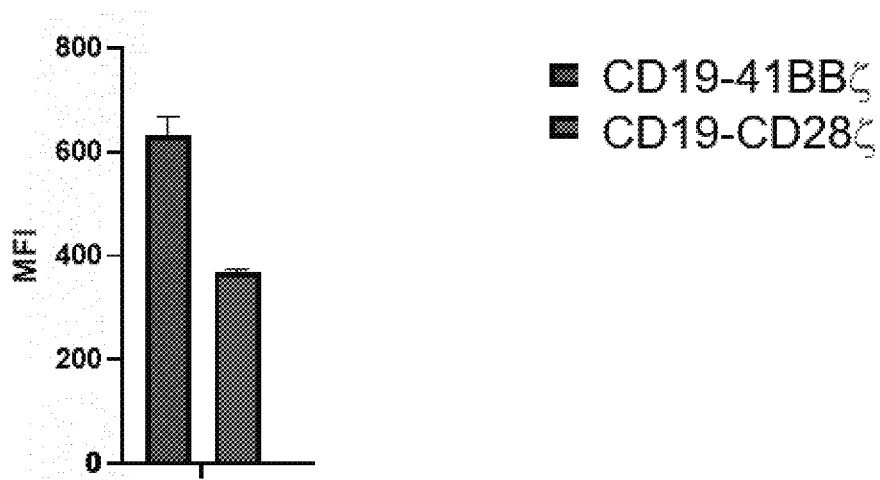

48 hours after co-culturing the T cells with the Nalm6 cells, the effector to target (E:T) ratio was 1:5. As seen in FIG. 106A, percent killing of the Nalm6 tumor cells post administration of the LNP-circRNA constructs was significantly greater for the constructs encoding CD19-CD28(or CD19-41BBζ compared to the constructs encoding HER2-41BBζ, HER2-CD28ζ, or mOX40L (the positive control). FIG. 106B illustrates that circRNAs encoding CD19-28ζCARs has a greater killing of Nalm6 cells than circRNAs encoding CD19-BBζCARs.

Example 99

1E6 (Nalm6-Luc) cells were engrafted into NSG mice. 3 days later, CD3/CD28 treated hPBMCs were engrafted ex vivo. 24 hours post engraftment, the mice were dosed via in vivo administration with LNP encapsulating circular RNA constructs (circular RNAs encoded either CD19-41BBζ CARs, CD19-CD28ζ CARs, HER2-41BBζ CARs, HER2-CD28ζ CARs or mOX40L (positive control)) or PBS (negative control 1) or PBMC (negative control 2)) at 2 mg/kg. All of the LNPs were formulated with ionizable lipid 10b-15 (Table 10b, Lipid 15). The mice were dosed every other day for a total of 5 doses. Nalm6 tumor burden over time was quantified using IVIS imaging.

Figure 107:
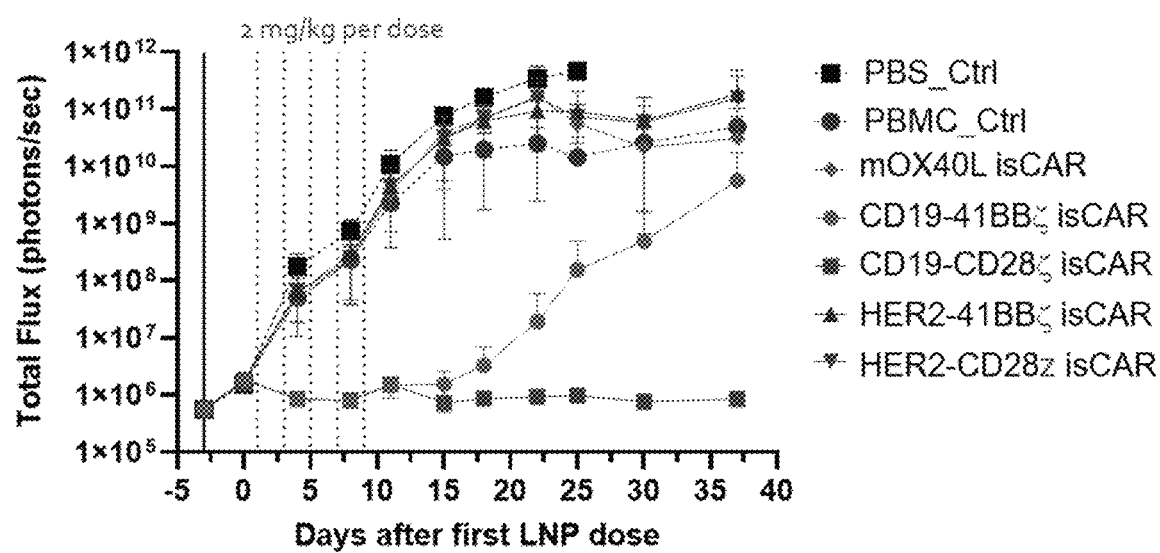
FIG. 107 depicts antigen-dependent tumor regression measured by total flux (in photons/sec) following dosing of mice with either PBS, PBMC, LNP-oRNA encoding for mOx40L, LNP-oRNA encoding for CD19-41BBζ ("CD19-41BBζ isCAR"), oRNA encoding for and CD19-CD28ζ ("CD19-CD28ζ isCAR"), LNP-oRNA encoding for HER2-41BBz CAR ("HER2-41BBz isCAR"), or LNP-oRNA encoding for HER2-CD28z CAR ("HER2-CD28z isCAR"). PBS and PBMC solutions lacking oRNAs were used as negative control.

As seen in FIG. 107, LNPs formulated with CD19-CD28ζ CARs are more effective in tumor regression than the other CAR or controls (positive or negative).

INCORPORATION BY REFERENCE

All publications, patents, and patent applications mentioned in this specification are herein incorporated by reference to the same extent as if each individual publication, patent, or patent application was specifically and individually indicated as being incorporated by reference herein.

SEQUENCE LISTING (3779 sequences)

SEQ ID NO: 1 - DNA, 367 bp, Human parechovirus 4
  strain R12644/1999/HUN 5' UTR; and polyprotein1
tgaggtgtctgatgaggtgtgggaacttattggaagtgattacttgctgcaaagcatcctattgccagcggatcaacacctggtgacaggtgcccctggggccaaaagccaaggtttaacagaccctctaggattggtttaaacctgagtagtcatggaaaatacttagtacctgccaatttggtaacagtgcaaacactagttgtaaggcccacgaaggatgcccagaaggtacccgtaggtaacaagtgacactgtggatctgatctggggccatctacctctatcttggtgaggtggttaaaaaacgtctagtgggccaaacccaggggggatccctggtttcctttatcataccactatcatt

SEQ ID NO: 2 - DNA, 368 bp, Human parechovirus 1
  strain R2594/1990/HUN 5' UTR; and polyprotein1
tgagacgtctgatgacgtgtgggaacttattggaagtaacaatttgctgcaaagcatcctattgccagcgggtgaacacctggtaacaggtgcctctggggccaaaagccaaggtttaacagaccctctaggattggttaaaacctgaattgttatggaaaatatttagtacctgccaatttggtagtattgcaaacactagttgtacggcccacgaaggatgcccagaaggtacccgaagttaacaagtgacactatggatctgatctggggccaactacctctatcttggtgagttggttaaaaaacgtctagtgggccaaacctgggggggatccccagtttccttttattttatcattgccact

SEQ ID NO: 3 - DNA, 373 bp, Human parechovirus
  isolate 13-51/BE/DE/2013 polyprotein gene,1
tttgtaagacgtctggtgacgtgtgggaacttattggaaataacatattgctgcaaagcatcctattgccagcggaacaacacctggtaacaggtgcctctggggccaaaagccaaggtttaacagaccctctaggattggtttaaaacctgatatgttgtggaagatacttagtacctgttgatctggtagtagtgcaggcactagttgtaaggcccacgaaggatgcccagaaggtacccgtaggtaacaagtgccactatggatctgatctggggccaggtacctctatcttggtgacctggttaaaaaacgtctagtgggccaaacccgggggggatccccggtttctttttattttattaatagcatt

SEQ ID NO: 4 - DNA, 389 bp, Bat pegivirus
  isolate PDB-106 polyprotein gene, complete cds.1
ggcatgggtccactggcgcgctgacgaaggtgcgcgtgctttgtaggcacggtccacaggtgtgcccactaccggtgtgaataagtgggggtctggagcgtcagaccttaaacctagtggtgcctgggatcgcaacgtggctcacgtacgccaacgccgcttaaaaccttcgggacagctatgcgggttgacaatggcagtgaggcgcggcaccgaccgtggatccggaatcggtgtgcgagttccccagtcgctagcccgtaagggcaagcatgggtccccccagctggcgcagcgctacatgcggcaagaggaagaaccttcgggtgacctcggggggaatgtccgttctcaatgagctgaggagcatcgcacggctcgtcgccaag

SEQ ID NO: 5 - DNA, 398 bp, Ferret parechovirus
  isolate MpPeV1 polyprotein gene, complete cds.1
ctacctatcctacttcttgtatatcattctttgctattaagtagggatcccctgctatttgcaggtgtgcttgcagtggagctacacaactgtggccgaggcacggctcgcccccgtgtattaggactcttttgtgccactgttaagcggacgtatgtcagttgagtgatatctcagtgataaaccatgagtacatggtaatcctggcgtggactcattgggacggtatttcctatcccgtagactccttgtagccaggtgggcatgcccaatcacaatggtagcacctctcatgggagtgagggggcctgagttagtactcagtcacacagcctgatagggtagcggctctgctactgaccagcgtctttaaataactgagagctgtttattaacct

SEQ ID NO: 6 - DNA, 419 bp, Bat pegivirus
  isolate PDB-838 polyprotein gene, complete cds.1
gtggtaaatcccggctacggtggatccatgaatagcgtagggtgtgccaccactgctgggtgggacgacgcaggatcaaaggggacggcacggtccacaggtgagccaaccggtgtgaatatggcacgtctttgggcatgacgttaaactgagacgccctgcaggatgacaacatggctgagggttgcggaacgccgcttaaaaccattcgtggacagcgatgcgggttgacaatccgtcctcaggcgtggcggccatattggttggtcgtgtcagttcccttcagggtgcgcttcggcgaagcatggccccccccagctggcgcaggcccacatgcggcaagacgaaaaatccttcgggtgacgtcgggggggattttccctttacctacatgcatgttgttccgtttcggcgcaacc

SEQ ID NO: 7 - DNA, 421 bp, Human parechovirus 1
  isolate 37Chzj76, complete genome.1
tctattagtgagataccacgcttgtggaccttatgctcacacagccatcctctagttagttggtgaggtgtctggtgacgtgtgggaacttaccggaagcattattttgctgtaaggcatccattagccagcggaacaacacctggtaacaggtgcccctggggccaaaagccaaggtttaacagaccctaatggattggttcaaacctggaataatgtggaaggtacttagtacctgccgaactggtagcaatgccaacactagttgtaaggcccacgaaggatgcccagaaggtacccgtaggtaacaagagacactatggatctgatctggggccaactacctctatcttggtgagttggttaaaaaacgtctagtgggccaaacccaggggggatccctggtttcctaatttttact

SEQ ID NO: 8 - DNA, 426 bp, Rodent pestivirus
  isolate RtNn-PestV/HuB2014 polyprotein gene,1
gtataagggatgggatccttgtacatttcatacctctaccgaacagtatttgggagttctttttacctgccgtacagtattgggatttaaacaactaaatgtttacaaatcacgtgtgtggtggcggggatagaccgtgccagcggttgtgtaccagcaatcacaaacaacacgtggactgcaatccaggagagcacctaggtctgttaagttgtgagtacacgacattcgtcaatgagtcagctggtaaggatcacccacctggatactcatgtggacgagggagtttcccaaacagtaacctactctgggggaggggtcccccagagacaatttgtctcaaatatgggataagttggggtgtgctgcctgacagggtctcggctgatagcctggaaagcagtataatatcagttgaattggcat

SEQ ID NO: 9 - DNA, 436 bp, Human parechovirus 6
  strain BNI-67/03 polyprotein gene, complete1
ataattctatcagtgggataccacgcttgtggatcttatgcccacacagccatcctctagtaagtttgtaagacgtctgatgacgtgtgggaacttattggaagtgacattttgctgcaaagcatcctattgccagcggaataacacctggtaacaggtgcctctggggccaaaagccaaggtttaacagaccctttaggattggtgttaacctgaagtgttatggaaaatatttagtacctgctgatttggtagtaatgcaaacactagttgtaaggcccacgaaggatgcccagaaggtacccgtaggtaacaagagacactatggatctgatttggggccaactacctctattaaggtgagttggttaaaaaacgtctagtgggccaaacccaggggggatccctggtttccttttattttactacattcaac

SEQ ID NO: 10 - DNA, 439 bp, Human parechovirus 17
  isolate 27Chzj76, complete genome.1
tgccataactctattagtgagataccatgcttgtggaacttatgctcacacagccatcctctagtaagtttgtaagacgtctggtgacgtgtgggaacttgtgggaatcaatgccttgctgtaaagcatccattagccagcggacaaacacctggtaacaggtgcctctggggccgaaagccaaggtttaacagaccctaatggattggttcaaacctgagacattgtggaacacacttagtacctgctaatctggtagtaatgcaaacactagttgtaaggcccacgaaggatgcccagaaggtacctgtaggtaacaagtgacactatggatctgatctggggccagttacctctatcttggtgaactggttaaaaaacgtctagtgggccaaacccaggggggatccctggtttcctttttattttactagtcatt

SEQ ID NO: 11 - DNA, 441 bp, Human parechovirus 4
  isolate TW-00032-2011 polyprotein gene,1
cataactctattagtgagataccatgcttgtggaccttatgctcacacagccatcctctagtgagtttgcaagacgtctgatgacgtgtgggaacttaatggaaacaatatcttgctataaagcatcttactgccagcggaacaacacctggtgacaggtgcctctggggccaaaagccaaggtttaacagaccctttaagattggttcaaacctgaggtattgtggaaattatttagtacctgccgatttggtagtagtgcaaacactagttgtaaggcccacgaaggatgcccagaaggtacccgtaggtaacatgtgacactatggatctgatctggggccaactacctctatcaaggtgagttggttaaaaaacgtctagtgggccaaacccaggggggatccctggtttcctttatcttatcacacaattatcatt

SEQ ID NO: 12 - DNA, 471 bp, Unknown
  Description of Unknown: Kobuvirus cattle/Kagoshima-1 -22-KoV/2014/JPN genomic RNA, nearly 1 sequence
catccccaatatgttcggtgaggaatgctaccacgtaactattagtgaacccattgactgttctgccctggcaaggctatagagtacagtgttccgctgtggatgccgtcctggtaacaggatccccagtgtgtgtagctgtatgttcaacttcggttgttcacagtccttggtctagcttttagtgaaatggtgtgcgccatatccctacatttgggtgccacctctcaacccctaggaatgctaggaaggtaccccaccctccggtgggatctgatcctaggctaattgtctatggggttgtttccttttcttttcaccactcattactggctcacagattgtttgttgtgttccctgctctctctagctcccaacacggcacacagtctcagccacaccgcctttgcaaacgactaccagatttgtttctttgactcctctgattctcacatcttcactgaaccagac

SEQ ID NO: 13 - DNA, 481 bp, Avihepatovirus sp.
  isolate MW24 genomic sequence.1
gttgggtttacgtaagtattacccaaccctcctttcaacgtctggcccacgatacgggccaccctttcctatctcctctctttccaagtaagatattttattggttaactgacctctgtgcggcacgacaatgatgtggacaagtgttttacttaggtggtttagccagccatttcctcggcaatagcttctaggagaggagaaatggtaggtgcaacctggtaatggttctcctgaaatcgtccagtagggaggatcctcttccagataattgtactgactaggtgaagtagactggactagctgtgaggtccggggccagcattgctataccccctctaatccggcgtggatttccggccattggatagagcttacagctagcagggtattggggtaaccctgttgatccagactcctgataaggggaactgcctgtttcacgacccacctagtataaaatacaggctgtatttatgaa

SEQ ID NO: 14 - DNA, 488 bp, Eel picornavirus 1
  strain F15/05, complete genome.1
cacatggaaagcttttcgcttccatgtttacgcacacactctctttgacaccctgttgtatggtgttaaactacaacatttgtctgtctataatcgtttattttgtttaccctatatgtacccaagtatttgattgcttgactcacataagcatcggtaacccatactgttttatgagctactacctctgctgtctacatacattttatatgaatggtttgagctctgcctcaggatcaaacatggtaacatgttcctttggtcagttagaatcttattgtataatctaaggtgtctattagtacgtagaaagttgtaacacatatggggcctgatagccgctatctctgatggatgtaaggtaaccttctttaggtctgatacattctgcacaggatccaattttcggtgccctgtacgagtgcactcttatgcacgaggacgagatatgctacaacccactgcaaatttaaacccaaactttaaca

SEQ ID NO: 15 - DNA, 509 bp, Burpengary virus
  isolate 1 polyprotein gene, complete cds.1
ctccccccccttccccttcccgagtaggagattggcatgtatgctctacatgcccgattctctcttgctcactctcttaaatcctggtggcggtctcggattaaacatttatgtcgtatctgggatcgtcttacttggtggtaattcctctgttgcctagggacctccggactgccggattaaaggtctcaacagagggcaatgtacaaggaagtcattatacgctaattaagtatttgatgaatgactagtgtgacagggctgaggaactccccccgggtaaccggtgcctcagcgtccgaaagacacgtggataggatccaccctgttatacccagcacgatgtaatagtcaaatacctctgatttgtgtaggatgtataaattgtgcattgtaaattttgggcgtagagatgctccgaaggtaccccgttttacgggatctgatcggaggctaattacccaatgcgccctaaataacttcatataatttctttttctttattcaaa

SEQ ID NO: 16 - DNA, 519 bp, Goose megrivirus
  isolate W18, complete genome.1
ttcgggacactggatgggcgacttggtggggctgccactctatcttgacctttcgttactgactttcggatctctgactcctccttgtctcttgcgtttggtccacggacggactaattggaatgtttactggctaagcctcgttctgaaataccctagccaatgggttgtagtaggatcctggtgtttccattaaacctcttccgaccatagtagctagagttatggctgtgtaggatgtgggtaagaccgctttttgcgtatctcccacaagacaccggattatggatgtgtccgctggataaggctcgaaacctcccaactgaaggtggtgctgaaatattgcaagcctaggttgtgtagaggcaagtagatgcctgccgcgacattcgtcttccgcccttttgggttagtagtgtacctacatggacgtggggctgggaatccccaccttgcataacactggttgatagacctgcggctggtcaagttactatggtataaccagttgaaatggct

SEQ ID NO: 17 - DNA, 519 bp, Ferret kobuvirus
  isolate MpKoV32 polyprotein gene, partial cds.1
accctcttttccggcggcgcaagttcgcgtcgtcgtaagcctggactcccatggtgtacatcggtttccgggcaaatacaagaaccccagttttcctggtaattccttgactgggtcaaagaaataaggaaccagcccctctaacgccagacgagcggctttaaacttgaacttctggcacaatttcttccactaccctttccccaaactcggactgactcactggattttgaccttccccctttgtctgaccactcttttggatctccctccaatatgccggtggtgcctggcggaaaaagcacaagttgtgtgagcaacacccccacaggtctcacggaacggtctgtgcccgcagatctagtacgtgcggatccctggttgcttccactgctcgcctgtgagtagagtaggtgctgggtgtgatgtgtcttcggacacctcgggcatagcattgctcccccgagaatcaagccatcgagatttctctggcctctgaagtcacgcctggacgcgtag

SEQ ID NO: 18 - DNA, 528 bp, Southwest bike trail virus
  isolate cj1516, complete genome.1
gtcaggtggaaggcctgaaaccgatcctacaattggagagtaaccaacatgctcattaacacctcgggctggctcgaaagccggtgttgggcagatggcagggttcttagggtaaatcccggtctgtctggatccggtatagagctggcactggaggtccactgttggcttgctgaagtgctcagaagattgatggacacggtacacaggtttggatgcaccggtgtgaatagcgtcccgtcaggagcgtctgacgttaaactgagtccccctcaacgatcgcaacatgggattgcgtacggacacgccgccaaaacccttcggggacagctatgcgggttgacaagtccagcagtcgcgtggggcctatattgtttaggcctgcgagttccggtttgggggagccgaaaggcagccatgggggtaccaaggcggcgtcgcgctacaggcggcaaggggaaaaatccttcgggtgacccctggtaccatttttccttattgggtgttatgggtgtcggaaacgccacc

SEQ ID NO: 19 - DNA, 528 bp, Human parechovirus 19
  isolate 67Chzj11, complete genome.1
ttgtgtcaaatttgtagtgtttacagtagttgtagcttgcacgacatccttgttctccggttgggctgtggttgcaaaactatttggtcctagtaaattagaagcatcatctgcaactttggttattatttccccgccaacttcattgccagaaataatattattagcttcagtttctacattagacaaggagagagtatccatagcaccagtagcaacattaactaaatccttgatagactccataatggctgtttaaaattaaaagaaaaccagggatcccccttgggattggtttaaacctgaactactatggaagacatttagtacctgccaatttggtagtagtgcaaacactagttgtaaggcccacgaaggatgcccagaaggtacccgtaggtaacaagagacactatggatctgatctggggccaactacctctatcttggtgagttggttagaaaacgtctagtgggccaaacccgggggggatccccggtttcctttatttaataattagattcatt

SEQ ID NO: 20 - DNA, 531 bp, GB virus A
  Hepatitis, strain Alab polyprotein precursor, complete1
gccgggtggaaggcccggaaccgccccaccacctcaactaggtggtaagggtacgtctatcggtccggctggcccgaaaggcggtggatcctgtgtgttagggttcgtaggtggtaaatcccagcacaggtggtaatcgctatagggcaggcttatcccggtgaccgcttccctggatcctggagcgggtcgtggcggcacggtccacaggagtggggcctccggtgtgaataagccctcgtctggagcatcagacgttaaactgagacgtcccgaagagatcggaacgacgccccacgtatggcaacgccgcttaaaacccttcggggacagctatgcgggttgacaatgccagtggggggccgggcccactattgttgtgggctccgagttcctctagggatggccgaaaggcagccatggggccacccaggcggcgccgtgctacaggcggcaaggggaaaaatccttcgggtgaccccgggtggcattccctcccttagcagcatgagtgtggtggtagctgcaacc

SEQ ID NO: 21 - DNA, 537 bp, Human parechovirus 5
  isolate ETH_P9_2016 polyprotein gene, partial1
gatatcatcttgcaataagaagagtggggttaagacgcttaaagcatagagacaattttcttttctaacccacatttatgtggggtggcagatggcgtgccatgactctattagtgagataccacgcttgtggaccttatgctcacacagccatcctctagtaagtttgtgagatgtctgatgacgtgtgggaacttattggaagcaacattttgctgtaaagcatcctattgccagcggaacaacacctggtaacaggtgcctctggggccaaaagccaaggtttaacagaccctttaggattggttcaaacctgaaatgctgtggaaaatatttagtacctgccaatttggtagtaatgcaaacactagttgtaaggcccacgaaggatgcccagaaggtacccgtaggtaacaagtgacactatggatctgatctggggccaaatacctctatcttggtgatttggttaaaaaacgtctagtgggccaaacccaggggggatccctggtttccttttattttataatcgctatt

SEQ ID NO: 22 - DNA, 544 bp, Bovine rhinitis B virus
  strain MexB10 polyprotein gene, partial1
tggcacaccttacctcgaaacaagctcgtccttttgctgtgcaacacagtctgtcctgttacacttgtgacggctcgcgacactgtttgcatagtgaaatcgaccaagacagcaattccaaatggtgaacctcgaacacccaagctggatccgtagctggacatgttagggtaaggaattcctccctggtaacagggaccttactggccaaaagccctgctctttgagcctagcatgttgttgaccccgaactgtccagtttggttagtacagggaattcatttgttgtggttgttcagaactcgacttctagtgagacagcctaaggatgccctccaggtaccctggggtaacaagtgacacccaggatctgaggaggggatcaccctgcgtgatttaaaaaacttctaagctgtcacggtgaccagaggctggcacctttcacttttaccacttctcaattgatcacaaacaaaggaattacgtaattgcagacccacaaactagttacacgagtactgttcttacttttaatacttgttat

SEQ ID NO: 23 - DNA, 546 bp, Human parechovirus 2
  isolate 51Chzj674, complete genome.1
tgccatagagtggaacgtgtctacattgcgaaaatcaggtgtgaaaggcattgttggagcagaagggtgctgagtcaagttagttgtgttgacagttgttgtagcttgtacgacatccttgttttcaggtgttgaagtcgttgcaaaacaatttggtcccagaacattcgatgcatcatcagccactttggttaacatgtcaccaccagctgcattactggggtttgtgatggtctcattaacagtgttgacagtagagtcaattgtcttagtgattccagtagccatatctgcaacacccttgattgtctccatagctgtgaataaaaataaaaggaaaccagggtcccccctggatttggtaaccgtgcttatactagttgtaaggcccacgaaggatgcccagaaggtacccgtaggtaacaagtgacactatggatctgatctggggccaactacctctatcttggtgagttggttaaaaaacgtctagtgggccaaacccaggggggatccctggtttccttttattttatcataatcact

SEQ ID NO: 24 - DNA, 560 bp, GB virus A
  Hepatitis, complete genome.1
gccgggtggaaggcccggaaccgaccctagggtggaacctggatgagggtgtggaagagactcccccatcggtccgaaagctggtggatggcgtgcggcagggttccgcaggtgggtaaatcccggcacgcttggatccggtataggataggtgggagccgaccggtcgaccccggtctggaccaccacggaagcacctgagcccggcggaagccccgtgggcacggtacacaggttgggcctaccggtgtgaataaggccccgtctcgagcggagacgttaaactgagaggtcctggtggatgggaacccggccctgcgtgttggaacgtcgctaaaacccttaggggacaatttccgaccgcgagttggcaaacctagcaggggcgggggcagtaggatggatctccgatctgctcccagttcccaccagggtcgccgtaaggcaagcatggggcccccaagctggcgcggcgctacacgcggcaagaggaagaaccttcgggtgacctctgggggcatgttggcttttcatgatgatgtgtggttgcagctgcaatc

SEQ ID NO: 25 - DNA, 563 bp, Rabovirus A
  strain Wencheng-Rn449 polyprotein gene, complete cds.1
cctcttttcttggcaaataagatggtggaccaaggtcgtctgtagttgtttggaacatttctttctaatgacttatgtcagcggtgaactcacaccgtaactcttctaccctatccccacacttgtggaactaggaggggatgagtgattcaagtaagtactgtcagaatggtgaaaatgatctgattctgaaacatcatggatccatcgtaagatggggctacacgcctgcggaacaacacatggtaacatgtgccccaggggccaaaagccacggtgataggatcacccgtgtagtttgagatcatatcaatgttcatggtctagtaagatgatttgaaatctaactgagctgatggctaactgcttgtcttattgcggcctaaggatgccctgcaggtacctttagataaccttaagagactattgatctgagcaggggccaaggtggtctttcccagccttggttaaaaagcgtctaagccgtggcagggggcgggaggccccctttcctcccaaactttaatattgattgtatggtgacaactgaaagacatagcaca

SEQ ID NO: 26 - DNA, 570 bp, Parechovirus A
  isolate HPeV-1/CMRHP46/CMR/2014 polyprotein gene,1
ctattaactatagccttgtgcctggtccccactagtcgaaggcatcttgcaataagataagtggaataaggacgcttaaagcacaatgaaagttaacttttctaacccacactatggtgtggggtggcagatggcgtgccataactctattagtgagataccacgcttgtggaccttatgctcacacagccatcctctagtaagtttgtaagacgtctggtgacgtgtgggaacttgtgggaatcaatattttgccgtaaggcatccattagccagcggataaaacacctggtaacaggtgcctctggggccaaaagccaaggtttaacagaccctaatggattggttttgaaacctgaaatattgtggaacacacttagtacctgctgatctggtagttatgcaaacactagttgtagggcccacgaaggatgcccagaaggtacccgtaggtaacaagagaaactatggatctgatctggggctgactactcctatctttgtgagtcagttaaaaaacgtctagtgggccaaacccaggggggatccctggtttcctttaattctatc

SEQ ID NO: 27 - DNA, 589 bp, Bovine rhinitis B virus 2
  isolate BRBV_SWE1 polyprotein gene,1
cgggtttgctgctttcacatagtaaagcagatagaggttttgtaatggcgcactttacctcgaaacaagctcgttgttttgctgtgtaacacggtctgtcctgtcacacttgtggcggctcgtgacactgtgcgcatagtgaaatcgaccaagacagcaacttcaaatgatgaacctcgaacacccaagctggatccgtagctggacatgttagggtaaggaattcctccctggtaacagggaccttactggccaaaagccctgctctttgagcctagcatgttgttgaccccgaactgtccagtttggttagtacagggaatttatctgttgtggttgttcagaactcgatttctagtgagacagcctaaggatgccctccaggtaccctggggtaacaagcgacacccaggatctgaggaggggatcaccttgcgtgatttaaaaaacttctaagctgtcacggtgaccagaggctggcacctttcacttttatcacttttaaactgaccacaagcaaaggaattacgtgactacaggctctcaaactagttacacgagtactgtttttacttttgacatttgttgt

SEQ ID NO: 28 - DNA, 591 bp, Human parechovirus
  strain MX polyprotein gene, complete cds.1
caacaaacatctaagacaattacatacaaccttgtacctggtccccaccagtcgaaggcatctagcaataagatgggtggaacaaggatgcttaaagcacaaagacaattaacttttctaacccacaatttattgtggggtggtagatggcgtaccataactctattagtgagataccatgcttgtggatcttatgctcacacagccatcctctagtaagtttgtaaggtgtctgatgatgtgtgggaacttattggaaacaacattctaccgtaaggtatccattagccagcggaacaacacctggtgacaggtgcctctggggccaaaagccaaggtttaacagaccctaatggattggttcaaacctgggatgttgtggaaaatatttagtacctgctgatttggtagcagtgcaaacactagttgtaaggcccacgaaggatgcccagaaggtacccgtaggtaacaagagacactatggatctgatctggggtcaactacctctatcttggtgagttgattaaaaaacgtctagtgggccaaacccaggggggatccctggtttccttttacttatcaaaatgatc

SEQ ID NO: 29 - DNA, 592 bp, Parechovirus A
  isolate LLL, complete genome.1
aatgtaactaacatctaagacaactattttacaaccttgtacctggtctccactggtcgaaggcaacttgcaataagataagtggaatgaagacgcttaaagtacaatgtaagtaatcttttctaatccacaattctgtggagtggcagatggcgtgccataactctaatagtgagataccatacttgtggacctcatgctcacacagccatcctctagtaagtttgtaagacgtctggtgacgtgtgggaacttatgggaatcaatgttttgctgcaaggcatctattagccagcggataaacacctggtaacaggtgcctctggggccaaaagccaaggtttaacagaccctaatagattggtttatacctgaaacattgtggaacatattcagtacctgccgatctggtagtaatgcaaacactagttgtaaggcccacgaaggatgcccagaaggtacccgtaggttacaagggacactatggatctggtctggggctgagtacctctatcttggtgactcagttaaaaagcgtctagtgggccaaacccgggggggatccctggtttcttttattttaatggtcact

SEQ ID NO: 30 - DNA, 592 bp, Human parechovirus 18
  isolate 11Chzj207, complete genome.1
cgtaacaaacatctaagattatcatattaaccccatgcctggtctccattagttgaaggcaacttgcaataaaataagtggaaataagacgcttaaagcatggtgtaagttttcttttctaactcacatcttgtgtggggtggcagatggcgtgccataactctattagtgagataccacacttgtggaccttatgctcacacagccatcctctagtaagcttgtaagacgtctggtgacgtgtgggaacttattggaaacatcattttgctgcaaagcatcctattgccagcggaacaacacctggtaacaggtgcccctggggccaaaagccaaggtttaacagaccctttaggattggttctaaacctgaaatgttgtggaagatatttagtacctaccaatctggtagtattgcaagcactagttgtacggcccacgaaggatgcccagaaggtacccgtaggtaacaagtgacactatggatctgatctggggtcaactacctctatctaggtgagttggttaaaaaacgtctagtgggccaaacccaggggggatccctggtttccttttatcttaaatagtgact

SEQ ID NO: 31 - DNA, 592 bp, Human parechovirus 5
  isolate 44Chzj84, complete genome.1
taacaaacatctaagacaaacaattacgaccttatgcctggtccccaccagtcgaaggcatctagcaataagataggtggaacaaggacgcttaaagcataaagacaataatcttttctaactcacacattggtgtgaggtggcagatggcgtgccataactctaatagtgagataccacgcttgtggaccttatgctcacacagccatcctctagtaagtttgtgaggtgtctgatgacgtgtgggaacttgttggaaatgacagcttgctgcaaagcatcccattgccagcggactaacacctggtaacaggtgcctctggggccaaaagccaaggtttaacagaccctttgggattggttcaaacctgagctgtcatggaagacacttagtacctgctgatttggtagcaatacaaacactagttgtaaggcccacgaaggatgcccagaaggtacccgtaggtaacaagtgacactatagatctgatctggggccggctacctctatcttggtgagtcggttaaaaaacgtctagtgggccaaacccaggggggatccctggtttccttttattttactaatgcaact

SEQ ID NO: 32 - DNA, 593 bp, Parechovirus A
  isolate CSS, complete genome.1
tgtaataatcttagatgtttgttacattaaccccatgcctggtctccactagttgaaggcagcttgcaataaaatgagtggaagcaagacgcttaaagcatggtgtaaattagcttttccagcccacaccttgtgtggggtggcagatggcgtgccataactctattagtgagataccatgcttatggaccttatgctcacacagccatcctctagtaagtttgtgagacgtctggtgacgtgtgggaacttattggaagcaacattttgctgtaaagcatcctattgccagcggaacaacacctggtaacaggtgcctctggggccaaaagccaaggtttagcagaccctttaggattggtttaaaacctgaaatgttgtggaagatacttagtacctaccgatctggtagtagtgcaaacactagttgtaaggcccacgaaggatgcccagaaggtacccgtaggtaacaagagacactatggatctgatctggggccgggtacctctatcttggtgacctggtttaaaaacgtctagtgggccaaacccgggggggatccccggtttccttttattttatcaatgccact

SEQ ID NO: 33 - DNA, 594 bp, Parechovirus A
  isolate HYRS, complete genome.1
actgtaactaacatctaagacaactattatacaaccttgtacctggtccccactagtcgaaggctacttgcaataagataagtggactaaggacgcttaaagtacaatgtaaacaatcttttctaatccacaattttgtggagtggcagatggcgtgccataaccctattagtgagataccacgcttgtggaccttatgctcacacagccatcctctagtaagtttgtgagatgtctggtgatgtgtgggaacttatgggaagtaatgtcttgctgtaaagcatccattagccagcgggtaaacacctggtaacaggtgcctctggggccaaaagccaaggtttaacagaccctaatggattggttcaaacctgggacattgtggaacatacttagtacctgctgatctggtagttatgcaaacactagttgtaaggcccacgaaggatgcccagaaggtacccgtaggtaacaagagacactatggatctgatctggggctgagtacttctatcttagtgactcagttaaaaaacgtctagtgggccaaacccgggggggatccccggtttcctttattttacaactaccatc

SEQ ID NO: 34 - DNA, 595 bp, Parechovirus A
  isolate LGSB, complete genome.1
gcacacacgaaaaggaatgcctgttgcattaaccccatgcctggtctccactagttgaaggcaacttgcaataaaatgagtggaaacaagacgcttaaagcatggtgtaaattaacttttctaacccacaccttgtgtggggtggcagatggcgtgccataactctattagtgagataccacgcttgtggaacttatgctcacacagccatcctctagtaagtttgtgagatgtctggtgacgtgtgggaacttattggaaacaacattttgctgtaaagcatcctattgccagcggaactacacctggtaacaggtgcctctggggccaaaagccaaggtttaacagaccctttaggattggtttaaaacctgaaatgttgtggaagatacttagtacctaccgatctggtagtattgcagacactagttgtaaggcccacgaaggatgcccagaaggtacccgtaggtaacaagagacactatggatctgatctggggccaggtacctctatcttggtgacctggttaaaaaacgtctagtgggccaaacccgggggggatccccggtttcattttgttttaccaatgccact

SEQ ID NO: 35 - DNA, 595 bp, Parechovirus A
  isolate AVSS, complete genome.1
actgtaacaaacatctaagattattgcatgctttaagcgtcttgtttccactagttgaaggcaacttgcaataaaataagtggaaacaagacgcttaaagcatggtgtaagttaacttttctaacccacatctcatgtggggtggcagatggcgtgccataactctattagtgagataccacgcttgtggaccttatgctcacacagccatcctctagtaagtttgtgagacgtctggtgacgtgtgggaacttattggaaacagcattttgctgtaaagcatcctactgccagcggaacaacacctggtaacaggtgcctctggggccaaaagccaaggtttaacagaccctttaggattggtttaaaacctgaaatgttgtggaagatactcagtacctaccgatctggtagtattgcaaacactagttgtagggcccacaaaggatgcccagaaggtacccgtaggttacaagagacactatggatctggtctggggccaggtacctctatctcggtgacctggttaaaaaacgtctagtgggccaaacccgggggggatccccggtttccttttgttttactaatgccatt

SEQ ID NO: 36 - DNA, 596 bp, Parechovirus A
  isolate CBC, complete genome.1
actgtaactaacacctaagcttacatcacagataccctatgcctggtccccaccagtcgaaggcatctagcaataagatgggtggagcaaggacgcttaaagcatagtgttattatgcatttctaactcgtgttcaacacgaggtggcagatggcgtgccataactctattagtgagataccacgcttgtggatcttatgctcacacagccatcctctagtaagcttgcaaggcgtctgatgacgtgtgggaacttattggaaataacagtttgctgcaaagcatcctattgccagcggatcaacacctggtaacaggtgcctctggggccaaaagccaaggtttgacagaccctctaggattggttcatacctgaactgttatggaagatacttagtacctaccaatttggtagttaggcaagcactagttgtaaggcccacgaaggatgcccagaaggtacccgtaggtaacaagtggcactatggatctgatctggggccaactacctctatcctggtgagttggttaaggcatccttcgtgggccaaacccaggggggatccctggtttcctttaaatttaatacaatcaat

SEQ ID NO: 37 - DNA, 597 bp, Parechovirus A
  isolate FNMR, complete genome.1
actgtaactaacatctaagctgatattccagccacctcaaggctggtccccactcgtcgaaggcatctagcaataagataagtggaagaaggatgcttaaagcatagtgttaatatgcatttctaacctgtgattatcacggggtggcagatggcgtgccataactctattagtgagataccacgcttgtggaccttatgctcacacagccatcctctagtaagtttgcaaggcatctgatgacgtgtgggaacttattggaaacaacagtttgctgcaaagcatcctactgccagcggaacaacacctggtaacaggtgcctctggggccaaaagccaaggtttaacagaccctttaggattggttcacacctgaactgttgtgaaagatatttagtacctactgacttggtagttaggcaaacactagttgtaaggcccacgaaggatgcccagaaggtacccgtaggtaacaagagacactatggatctgatctggggccaactaccactatcatggtgagttggttaaaaaacgtcttagtgggccaaacccaggggggatccctggtttccttttactttaatacaatcatt

SEQ ID NO: 38 - DNA, 603 bp, Bovine rhinitis B virus 5
  strain MexB09 polyprotein gene, complete1
tatcattcgaagatgtgcggttttgctgctttcacagagtaaagcagatagaggttctggactggcaaactttacctcgaaacacgcccgttttcctgctgtgttttacagactgtcctgccacacttgtggcggcttgtgacactgtgaacatagtgagaccgaccaagagaacagttccaagtgatgaacaccgaacacctagactggatccgtagctggacatgttagggcaaggatttcccccctggtaacaggagccttgctggccaaaagccccgctctttgagcctagcatgttgtcgaccccggactgtccagtctagttagtacatgggattcacttgtcatggttcttctaaactcggtctctagtgcggcagcctaaggatgccctccaggtaccccggggtaacaagcgacacccgggatctgaggaggggactactttacgtagtttaaaaaacgtctaagctgttacggtgaccagaggctggcacctttcattttttaaaacaaactactgattacaattgaagtgataacggttttacagactttcaaactagtagcacaagtactgttttccaacgcacacatttt

SEQ ID NO: 39 - DNA, 604 bp, Parechovirus A
  isolate HMS, complete genome.1
atcataaccaatacgatttctcattccatctcgaccgcttctaccacctctaccgccacgtcctccacgagcatcaagaaattcacgaaattcatcgagaatgcttaaagcatagtgttagtatgcattcttgatgctcgtggaggacgtggcggtagatggcgtgccataactctatcagggtgataccacgcttgtggatcttatgctcacacagccatcctctagtaagcttgcaaggcgtctgatgacgtgtgggaacttattggaaataacagtttgctgcaaagcatcctattgccagcggatcgacacctggtaacaggtgcctctggggccaaaagccaaggtttaacagaccctctaggattggttcacacctgaactgttatggaaaatacttagtacctaccgatttggtagttgtgcaagcactagttgtagggcccatgaaggatgcccagaaggtacccgtaggtaacaagtgacactatggatctgatctggggccaactacctctatcctggtgagttggttaaaaaacgtctaatgggccaaacccaggggggatccctggtttcctttaaatttactacaaccaat

SEQ ID NO: 40 - DNA, 604 bp, Bovine rhinitis B virus
  strain MexB29 polyprotein gene, partial1
ctgcagatatcaagatgtgcgggtttgctgctttcacagagtaaagcagatagagattttgtattggcacacttaatctcgaaacgcgctcgttctgctgtgtagttcagtctgtcctgtcacacttgtgacggctcgcgacactgtacacatagtgaaaccgaccaagacaaaagcttcaaataatgaacctcgaaatcccaaactggatccgtagctggacatgttagggtaaggaacacccccctggtaacagggaccttactggccaaaagccccgctctttgagcctagcatgttgttgatcccgaactgttcagtttggttagtacagggaatttctttgctgtctttgttcagaactcggtttctagtgagacagcctaaggatgccctccaggtaccccggggtaacaagcgacacccgggatctgaggaggggaccgccccgcgcggtttaaaaaacttctaagctgttgtggtgaccagaggctggcacctttcactttaaaacacttattaactggtcacaaacaaaagaattccgttttacagactttcaaactagttacacaagtactgtttcacttacaacaattgttat

SEQ ID NO: 41 - DNA, 606 bp, Zebrafish picornavirus-1
  strain IDEXX/ZfPV-1/2017/USA, complete1
aaataccctttcccccggagcctcaccggggaccgcctcatggtgacctgctcggtcactactgtggtggtgaacaaatgtctaggacctttcactccaaatccctttcccctttttctacttcttagtacgcctcggctcgctcatccgttgtgtgctcaaactccccttctcctacacccctttcccccccctcccgagtgactcgcacttagtcgtaggtttggtgtctttcaccatttctgtgcctatctatgtgtcctttggatccgccctcgaatgccctctagggtcttctgcgaaagcttgcaaagccgcgccccccctccactgttcttggggaccgtgcgcagccggaacttttgacatttgactgaacagtacagcaatgtagcatgtctcttgtctttgccggttagccctcgtggtcaaactttgtaagttagtacacttaagcactctcctgtggtttctcttgggaccttccaattgtaggaatccttggtatgccttcgaatagggacggacgctctaaatgccccgttcgcgaagtcgacgcctgaatgaccaaggtttttccacctttcctcaaaacccctcttttta

SEQ ID NO: 42 - DNA, 608 bp, Human rhinovirus 10
  complete genome.1
ttaaaactggatccagattgttcccatctggatttcccacgtggagttgtacactattattccggtaattttgtacgccagttttatgtacccccccctgtaacttagaagttttgaacaaggaccaataggcagtaaccacccaggttgctaaaggtcaagcacttctgtttccccggtcaaagttgatatgctccaacagggcaaaaacaactgagatcgttacccgcaaggtgcctacgcaaagcctagtaaccccttgaacgatgtgtggttggtcgttcggctgtaccccacagtagacctggcagatgaggctagatgttccccactggcgacagtgttctagcctgcgtggctgcctgcgcactctctgagtgcgaagccatacatttgacaaggtgtgaagagccccgtgtgctcaccttgagtcctccggcccctgaatgtggctaaccttaaccctgcagctagtacatgcaatccagcatgcagctagtcgtaacgagcaattgcgggacgggaccaactactttgggtgtccgtgtttcactttttccttttatatttgcttatggtgacaatatatagatttatatattgtcacc

SEQ ID NO: 43 - DNA, 608 bp, Human rhinovirus 30
  complete genome.1
ttaaaactggatccaggttgtccccacctggatctcccacagggagtggtactctgttattacggtaactttgtatgccagttttatcctccccacccctatgtaacttagaagttttacataaagaccaataggtagtaatcatccagattacttaaggtcaagcacttctgtttccccggttgatgttgatatgctccaacagggcaaaaacaacagaaatcgttacccgcaaagtgcctacgcaaagcctagtagcactttagaagttgtctggctggtcgctccgccatttcccctggtagacctggcagatgaggctagaaataccccactggcgacagtgttctagcctgcgtggctgcctgcacaccctatgggtgtgaagccatacaatggacaaggtgtgaagagccccgtgtgctcactttgagtcctccggcccctgaatgtggctaaccttaaccctgcagctagggcacacaatccagtgtgtatctagtcgtaatgagcaattgcgggacgggaccaactactttgggtgtccgtgtttctcttttatccttatgtttgcttatggtgacaatatatgaatatatattgacacc

SEQ ID NO: 44 - DNA, 609 bp, Turkey avisivirus
  isolate USA-IN1, complete genome.1
ttgaaagcgaatgtatggccgcatttccacactagtaactagtagtggtatgcggctgtgcattcgctttccccccctctttataggggcggtctttgtatctttactaatttcctacttttctatcatctctttttaaggtagggactaaggtctcctagcccttccccccctgggctttccaggatcaagggggttctaaagctaggccatgtttcctgagcctcatttagtacggagagttagtagtcataaaacatgccagtaaccttctagtgcccaagggtgacagagtggtaacactctccttggggcccgaaaggctagtgggcatagttgttaccaaggaaggggtccccaccccaacctgaactaacagctagaagctcaccttagaagaagtgctggatcccaacatgtcttataatgaaagctcaatggaaaggtgaggagatggaagcatgggggttcactgagtagatgccctgaaggagaaatctgatcaggggcccgtgactatacattaggtaaaccgggtataaaaaccatgaaaggtgacccacaaattttcctttatttttatgttttgttggtgtgaattcaggcaag

SEQ ID NO: 45 - DNA, 610 bp, Livupivirus A1
  strain newt/II-5-Pilis/2014/HUN, complete genome.1
tatctacatggggatccaggctgtatggaatgtctgtcttaacaagcactataccagaaagatccacccaaagtggtgggactgggactgtgaggtgagaaatcccgaaaccagccttctcaagcgtcggacgatctttctgttttagtgaacaccttgccttttaaatggatgacaacaccccttcagcaaatcgcaatctgaaatcccaaaagactgtttagccgaactctggtaatcactccggagaagtaggatacgcagcccctgtggactcttgatttcaggactcaaggtagctagagctggaacttcatggaatgacaaaggaatatatgcacattgtgcgctttcctggccttgtagcccgtcgtgaggatatgtcgttgggaatcgacatcttagtccagtactgcttgatagagtgtcggctggcacagttacctgagaataagtcagttgtacttaacatgaacaaaaaaaataactaccacaactaccacaatctaccaatacttgaattatgctgaatctcgtacagtaaaaacgttccgtggaaggacaagtattgaagtgcggttacatcatccgatacgcgctggatccctca

SEQ ID NO: 46 - DNA, 610 bp, Human parechovirus 1
  isolate TW-01319-2010 polyprotein gene,1
gtcaataaaagcctcaaacgtaacaaacatctaagataactaaacaaaccctatgcctggtctccactattcgaaggcaacttgcaataagaagagtgggcacaagacgcttaaagcatagagagagtttccttttctaacccacgttcgcgtggggtggcagatggcgtgccataactctaatagtgagataccatgcttgtggatcttatgctcacacagccatcctctagtaagtttgtaaggcgtctggtgacgtgtgggaatttattagaagcaacatcgtgctgtaaagcatcctattgccagcggaataacacctggtaacaggtgcctctggggccaaaagccaaggtttaacagaccctctaggattggttttgaacctgcgatgttgtggaaaatatttagtacctgccaatctggtagtcatgcaaacactagttgtaaggcccacgaaggatgcccagaaggtacccgtaggtaacaagagacactatggatctgatctggggccaactacctctatcttggtgagttggttaaaaaacgtctagtgggccaaacccaggggggatccctggtttccttttattttatcaatttcatt

SEQ ID NO: 47 - DNA, 610 bp, Human rhinovirus 32
  strain ATCC VR-1142, complete genome.1
ttaaaactggatccgggttgttcccacccggatctcccacgtggagttgtacactattattacggtaattttgtacgccagttttatatcccttaccccaagtaacttagaagataaacacacagaccaataggaggtggtcatccagatcactaagggtcaagcacttctgtttccccggtcaaggttgatatgctccaacagggcaaaaacagctgagatcattatccgcaaagtgcctacgcaaagcctagtaactacctcgaaagtacttgactggtcgctccgccataccccatggtagacctggcagatgaggctagaaatcccccactggtgacagtgttctagcctgcgtggctgcctgcacaccctttgggtgtgaagccaagtaatggacagggtgtgaagagtcgagtgtgctcactttgagtcctccggcccctgaatgtggctaaccctaaccctgcagctagggcacacaatccagtgtgtatctagtcgtaatgagcaattgcgggatgggaccaactactttgggtgtccgtgtttcttgtttttcatttataattgcttatggtgacaatatatagtattatatattggcgtc

SEQ ID NO: 48 - DNA, 610 bp, Human rhinovirus 2
  complete sequence.1
ttaaaactggatccaggttgttcccacctggatttcccacagggagtggtactctgttattacggtaactttgtacgccagttttatctcccttcccccatgtaacttagaagtttttcacaaagaccaatagccggtaatcagccagattactgaaggtcaagcacttctgtttccccggtcaatgttgatatgctccaacagggcaaaaacaactgcgatcgttaaccgcaaagcgcctacgcaaagcttagtagcatctttgaaatcgtttggctggtcgatccgccatttcccctggtagacctggcagatgaggctagaaataccccactggcgacagtgttctagcctgcgtggctgcctgcacaccctatgggtgtgaagccaaacaatggacaaggtgtgaagagccccgtgtgctcgctttgagtcctccggcccctgaatgtggctaaccttaaccctgcagctagagcacgtaacccaatgtgtatctagtcgtaatgagcaattgcgggatgggaccaactactttgggtgtccgtgtttcactttttcctttatatttgcttatggtgacaatatatacaatatatatattggcacc

SEQ ID NO: 49 - DNA, 612 bp, Human rhinovirus A2
  strain 12L4, complete genome.1
ttaaaactggatccaggttgttcccacctggatctcccatagggagtggtactctgctattacggtagccttgtatgccagttttatctcccctcccccatgtaacttagaagttttacacaaggaccaatagtcggtaatcagccagattactaaaggtcaagcacttctgtttccccggtcaatgctgatatgctccaacagggcaaaaacagcagcgatcgttatccgcaaagcgcctacgcaaagcttagtagcatctccgaaattgtctggttggtcgttccgccattttccccttggtagacctggcagatgaggctagaaataccccactggcgacagtgttctagcctgcgtggctgcctgcacaccctatgggtgtgaagccaaacaatggacaaggtgtgaagagccccgtgtgctcgctttgactcctccggcccctgaatgtggctaaccttaaccctgcagctagagcacgcaaaccagcgtgtttctagtcgtaatgagcaattgcgggatgggaccaactactttgggtgtccgtgtttcactttttctttttatattgcttatggtgacaatatatacatcatatatattgacacc

SEQ ID NO: 50 - DNA, 613 bp, Human rhinovirus 77
  strain ATCC VR-1187, complete genome.1
ttaaaactggatccaggttgttcccacttggatcccccaagaggggtagtactctattattacggtaattttgtacgccagttttatctcccttaccccctttgtaacttagaagatttaaacacagaccaataggcgacgatcatccagatcgtttaaggtcaagcacttctgtttccccggtcaatgctgatatgctctaccagggcaaaaacagtagagatcgttatccgcaaggtgcctacacaaagcttagtaacattttgaagagcatttggttggtcgctcagctattaccccatagtagacctggcagatgaggctagaagttccccactggcgacagtgttcttgcctgcgtggctgcctgcgcactctcatgagtgcgaagccatatgtttgacaaggtgtgaagagccccgtgtgctcaccttgagtcctccggcccctgaatgtggctaaccttaaccctgcagctagtgcatgaaatccatcatgtaactagtcgtaatgagcaattgcgggatgggaccaactactttgggtgtccgtgtttcactttttccttttatatttgcttatggtgacaatatatatagcatatattgacacc

SEQ ID NO: 51 - DNA, 613 bp, Human rhinovirus A25
  strain SC0881, complete genome.1
ataaaactggatccaggttgttcccacctggatctcctacgtggagttgtactctattattccggtaatcttgtacgccagttttatatcccctacccctttgtaacttagaagttaaacacacagaccaataggcggtggctatccaagtcactaatggtcaagcacttctgtttccccggtcaagattgatacgctccaacagggcgaaaacagtcaagatcgttaaccgcaaagtgactacgcaaagcttagtaatgccttgaagagtctatggctggtcgttccgctataaccccctagtagacctggcagatgaggctagaaacaccccactggcaacagtgttctagcctgcgtggctgcctgcacaccctttcgggtgtgaagccatatatttgacaaggtgtgaagagccccgtgtgctcactttgagtcctccggcccctgaatgtggctaaccttaaccctgcagctagcgtatgtaatccaacatattgctagtcgtaatgagcaattgcgggatgggaccaactactttgggtgtccgtgtttcacttttttccttttatttgcttatggtgacaatatatatagtatatatattggcatc

SEQ ID NO: 52 - DNA, 614 bp, Human parechovirus 6
  isolate 71Chzj169, complete genome.1
ggctggttaataaaagcctcaactgtaacaaacatcttaagcaactatagcaaccccatgcctggtctccactagttgaaggcacctagcaataaaatgagtggaaataagacgcttaaagcatggagtaaattttcttttctatcccatattttgtatggggtggcagatggcgtgccataattctattagtgggataccatacttgtggatcttatgcccacacagccatcctctagtaagtttgtaagacgtctggcgatgtgtgggaacttattggaagcaacattttgctgcaaagcatcctactgccagtggaacaacacctggtaacaggtgcccctggggccaaaagccaaggtttaacagaccctttaggattggtattaacctgaaatgttgtggagaatagttagtacctgctgacctggtagtaatgcaaacactagttgtaaggcccacgaaggatgcccagaaggtacccgtaggtaacaagagacactatggatctgatttggggccaactacctctattaaggtgagttggttaaaaaacgtctagtgggccaaacccaggggggatccctggtttcttttattttaccatatctaac

SEQ ID NO: 53 - DNA, 614 bp, Human rhinovirus A21
  isolate rmh001/2013 polyprotein gene, complete1
taaaactggatccaggttgttcccacctggatctcctattgggagttgtactctattattccggtaattttgtacgccagttttatcttccccctccccaattgtaacttagaaggttatcaatacgaccaataggtggtagttagccaaactaccaaaggtcaagcacttctgtttccccggtcaaagttgatatgctccaacagggcaaaaacaactgagatcgttatccgcaaagtgcctacgcaaagcctagtaacacctttgaagatttatggttggtcgttccgctatttcccatagtagacctggcagatgaggctagaaatcccccactggcgacagtgctctagcctgcgtggctgcctgcgcaccccttgggtgcgaagccatacattggacaaggtgtgaagagccccgtgtgctcactttgagtcctccggcccctgaatgtggctaaccttaaccctgcagctagtgcatgtaatccaacatgttgctagtcgtaatgagtaattgcgggacgggaccaactactttgggtgtccgtgtttcactttttccttttaatattgcttatggtgacaatatatatagctatatatattgacacc

SEQ ID NO: 54 - DNA, 614 bp, Human rhinovirus 85
  strain ATCC VR-1195, complete genome.1
ttaaaactggatccaggttgttcccacctggatttcctacatggagttgtactctgttattccggtaaccttgtacgccagttttatatcccttcccccttgcaacttagaagttaagcacgcagaccaataggtggtgattatccaaatcactaacggtcaagcacttctgtttccccggtttaaactgatacgctccaacagggcgaaaacagtgcaaatcgttatccgcaaggtgcctacacaaagcttagtagcgctttggagaatgtgtggttggtcgctcagctataccccctagtagacctggcagatgaggctagaagcaccccactggcgacagtgttctagcctgcgtggctgcctgcacacccttatgggtgtgaagccatacatttgacaaggtgtgaagagccccgtgtgctcactttgagtcctccggcccctgaatgtggctaaccttaaccctgcagctggtgcatgtaatccaacatgttgctagtcgtaatgagcaattgcgggatgggaccaactactttgggtgtccgtgtttcactttttaccttttaatttgcttatggtgacaatatatatacaacatatatattggcatc

SEQ ID NO: 55 - DNA, 614 bp, Human rhinovirus 57
  isolate fs ship#1-hrv-57, complete genome.1
ttaaaactggatccaggttgttcccacctggatctcctacgggagttgtactctgttatttcggtaaccttgtacgccagttttatctcccctcccccaattgtaacttagaagcaatacacaaggaccaataggcagtgattaaccagatcacttaaggtcaagcacttctgtttccccggtctgagttgatatgctctaacagggcaaaaacaagtcagatcgttatccgcaaagtgcctacgcaaagcctagtatcatctttgaaaatgtatggttggtcattccgctgaaccccacagtagacctggcagatgaggctagaaaccccccactggcgacagtgttctagcctgcgtggctgcctgcacacccttatgggtgtgaagccatatatttgacaaggtgtgaagagccccgtgtgctcactttgagtcctccggcccctgaatgtggctaaccctaaccctgcagctagtgcatacaagccagtatgttgctagtcgtaacgagcaattgcgggatgggaccaactactttgggtgtccgtgtttcactttttacctttatactgcttatggtgacaatatatatatagcatatatattgacacc

SEQ ID NO: 56 - DNA, 614 bp, Human rhinovirus 59
  strain 16-J2, complete genome.1
ttaaaactggatccaggttgttcccacctggatctcccaagtggagtggtacactattatcccggtaattttgtacgccagttttataacccctcccccccttgtaacttagaagatgtaaacacagaccaataggtggtaactaaccaagttactaaaggtcaagcacttctgtttccccggctgatattgatatgctccaccagggcaaaaacaatagaagtcgttatccgcaaagtgcctacgcaaagcctagtagcactttagattgtgtatggttggtcgctcagctattccccctagtagacctggcagatgaggctagaaataccccactggtaacagtgttctagcctgcgtggctgcctgcgcaccctttcgggtgcgaagccatatacatgacaaggtgtgaagagccccgtgtgctcactttgagtcctccggctcctgaatgtggctaaccttaaacctgcagccagtgcacataagccaatgtgtagctggtcgtaatgagtaattgcgggatgggaccaactactttggatgtccgtgtttcttgtttttcctttaattttgcttatggtgacaatatatagataatatatattggcatc

SEQ ID NO: 57 - DNA, 617 bp, Picornaviridae sp.
  isolate thr173pic1 genomic sequence.1
gggccccctttccgtccaagtcgcggacgttaaatgcggcacggcagtgcctcggtgctgtcctgctgctagtggcggcaaccctctcccttactgtatgaatgagtttgtgtgaatgaaatccgtgtggatccccagcttttgggtctcaaacagaacacacggtggcggcccatgttccaccatagaggctaccttagtagctttaagtggaatctttgagtgagcaggtatcgcagccgttaaagactggtattcccggtgtagaggcgagcgcaggtaactgcggtctacattgtgtgtgagccagtacccgcaaggggtagctcaaagtggaaacttaaggtgaaccggtaagcgctattgtgacgcatgttggtcccaaggtgcgatgatagacatgttgcgcaggtaccccttaaatgggatctgagcgtaagctaattagtcactgtcgtcgcgctgaccttttctctttgtcttaattattgttaacacaatatcattgtttgttgtgtgtttttgctcgcaaggtcactagcagtcttacttaaaacactcaagacggactttttgtataattcaattagtgcttatttcaattctaccttctacag

SEQ ID NO: 58 - DNA, 618 bp, Human parechovirus 1
  isolate 121Chzj091, complete genome.1
cacgagttagaaatacatactaacactatgctttaagcgtccttgctccactcatcttattgcctggtccccactagtcgaaggtatctagcaataagatgagtggagcaaggacgcttaaagcatagtgttagtatgtatttctaactcgtgttcaacgcgaggtggcagatggcgtgccataactctattagtgagataccacgcttgtggatcttatgctcacacagccatcctctagtaagcttgcaaggcgtctgatgacgtgtgggaacttattggaaataacagtttgctgcaaagcatcctattgccagcggatcaacacctggtaacaggtgcctctggggccaaaagccaaggtttaacagaccctctaggattggttcacacctgaactattatggaagatatttagtacctaccgatttggtagttaggcaagcactagttgtagggcccacgaaggatgcccagaaggtacccgtaggtaacaagtgacactatggatctgatctggggccaactacctctatcctggtgagttggttaaaaaacgtctagtgggccaaacccaggggggatccctggtttccctttaaatttaatacaaccaat

SEQ ID NO: 59 - DNA, 618 bp, Human rhinovirus 11
  complete genome.1
ttcaaactggatccaggttgttcccacctggatctcccacgtggagttgtactctattattccggtaattttgtatgccagttttatctccccttcccttttgtaacttagaagatgaactcaccgaccaataggtggcatttatccagaatgtcaaaggtcaagcaccttctgtttccccggtcaaagttgatatgctccaacagggcaaaaacatctgcgatcgttatccgcaaagcaactacgcaaagcctagtatcacttttgagagtatgtggttggtcgctccactataaacccaatagtagacctggcagatgaggctagaagtcccccactggtaacagtgttctagcctgcgtggctgcctgcgtgcctctggtaggcacgaagccatatatttgacaaggtgtgaagagccccgtgtgcttgctttgagtcctccggcccctgaatgtggctaaccttaaccctgcagctagtgtgcataatccaatgcatggctagtcgtaatgagcaattgcgggatgggaccaactactttgggtgtccgtgtttctcatttttccttttatttgcttatggtgacaatatatataatacatatatattggcatc

SEQ ID NO: 60 - DNA, 620 bp, Picornavirus HK21
  polyprotein gene, complete cds.1
aaacgggaggatcggctttggcttatcctcttaatagtctacaaaactgggctgactggtgggggagctactagatccgggagaggactagttaccccgcgtaacttccctttttgtcactccctccacctaccccttccctgtcccttagactcttaagtaggtgtgcaggcctggccccccggaaatgggcaaatcggacgtttgcgtgtagggtcgttctgaaaggtggggcccactccaccgtagtaggatcttcctgtttcacgtttaaacctctccgggcaggtatcgctagacactaggctgtataggatggcacgcacttaggtttcgcaccttcctagtgcgccaagatcccgcttttgagctcaagtacatggttctttgtaagatgtctaaccagaggaggtggtgctgaaatattgcaagccactctggcgaacgtccactgcattgcctggaacaggctctctagcgccctccactggtagcgcggtggtgggttagtaggatacctatatggacaggggatgcgggaatacccctcactagctagtgactggttgatcgactggcggcggatccagtgatacttgcataatccgcagacttgggag

SEQ ID NO: 61 - DNA, 620 bp, Human parechovirus 5
  strain HPeV5-G001-19, complete genome.1
gggtcggctggtcaataaaagcctcacatataactaacatctaagacaataatgtacaaccttgtgcctggtccccaccggtcgaaggcatctagcagtaagataggtggaacaaggacgcttaaagcacaaagacaacctatttttctaacccgcaaattattgtggggtggtagatggcgtaccataattctactagtgagataccatgcttgtggatcttatgctcacacagccatcctctagtaagtttgcaaggcgtctggtgacgtgtgggaacttattggaaataacatcttgctgcaaggcatccattagccagcggaataacacctggtaacaggtgcctctggggccaaaagccaaggtttagcagaccctaatggattggttcaaacctgggatgttgtggaagatacttagtacctaccgatctggtagcaatgcaaacactagttgtaaggcccacgaaggatgcccagaaggtacccgtaggtaacaagagacactatggatctgatttggggccaactacctctatcctggtgagttggttaaaaaacgtctagtgggccaaacccaggggggatccctggtttcttttacttatcactgtcatt

SEQ ID NO: 62 - DNA, 621 bp, Human rhinovirus 84
  strain ATCC VR-1194, complete genome.1
ttaaaacagcggatgggtatcccaccatccggcccactgggcgtagtacactggtattctgtacctttgtacgcctgtttgccgcccctcccccttttattaccacatttgtggtcgctgcaacgttagaagattttaaagtagtgcaataggaagcatcacaaccagtggtgttatgcacaaacacttctgtttccccggagcgaggtatagacggtccccactgtcaaaagcctttaaccgttatccgccaaccaactacgagacagctagtaatgccctgttctcctgcaaggcgttcgatcagacagatttcccctctgttagtctggtcgatgaggctagaagtaccccacaggtaactgtgttctagcctgcgtggcggccagcccagcttctgctgggacgcctttcaagagacatggtgtgaagactcaattgtgcttggttgtgagtcctccggcccctgaatgcggctaaccttaaacccggatccatgctatgcaaaccagcatagttatggtcgtaatgggcaactctgggatgggaccgactactttgggtgtccgtgtttccatttttactttttgtgtcatttatggttacaattaagttgtaacc

SEQ ID NO: 63 - DNA, 621 bp, Human rhinovirus 20
  strain ATCC VR-1130, complete genome.1
ttaaaactggatccaggttgctcccacctggatctcctacatggagttgtactctattattccggtaattttgtacgccagttttatctccccctacccccttacgtaacttagaagttttacacacaccgaccaataggtggtatttacccaaaataccaaaggtcaagcacttctgttaccccggtcaaaattgatatgctccaccagggcaaaaacaattgcgatcgttatccgcaaagcaactacgcaaagcctagtaccatttttgatgatgtgtggttggtcgttccactatgaacccgatagtagacctggcagatgaggctagaaattccccactggcaacagtgttctagcctgcgtggctgcctgcgtaccccctgtgggtacgaagccatacatttgacaaggtgtgaagagccccgtgtgcttgctttgagtcctccggcccctgaatgtggctaaccttaaccctgcagctagtgtgtacaatccagtacatagctagtcgtaatgagcaattgcgggatgggaccaactactttgggtgtccgtgtttcttgtttttctttcatatttgcttatggtgacaatatatataacacatatattggcacc

SEQ ID NO: 64 - DNA, 625 bp, Bovine rhinitis B virus
  isolate TCH8 polyprotein gene, complete1
gtccagctacggatccagtttagacgttcgaagatgtacggttttgctgctttcacagagtaaagcagatagaggttctggactggcaaactttacctcgaaacacgcccgtttttctgctgtgttttacagactgtcctgccacacttgtggcggcttgtgacactgtgaacatagtgagactgaccaagacaacagtttcaagtggtgaacatcgaacgtctaaactggatccgtagctggacatgttagggcaagggtctcccccctggtaacaggagccttgctggccaaaagccccgctctctgagcctagcatgttgtcgaccccggactgttcagtttagttagtacatgggattcacttgtcatggttcctctgaactcggtctctagtgcggcagcctaaggatgccctccaggtaccccgaggtaacaagcgacactcgggatctgaggaggggactactttacgtggtttaaaaaacgtctaagctgccacggtgaccagaggctggcacctttcactttttaaacacactactgactacaattgaagtgataacggttttacagactttcaaactagttacacaagtactgtttttccaacacacacaatttt

SEQ ID NO: 65 - DNA, 630 bp, Human rhinovirus 37
  complete genome.1
tttaaacagcggatgggtatcccaccatccgacccactgggtgtagtactctggtattttgtacctttgtacgcctgttgttcctaatgtacccaccctaaaacttcctacccaagtaacgttagaagtttcatcaacaagtacaataggaagcatcacatccagtggtgttttgtacaagcacttctgtttccccggagcgaggtataggctgtacccactgccgaaagcctttaaccgttatccgccaaccaactacgtaaaagctagtatcatcatgttttaaaataggcgttcgatcaggtggatcccccctccactagtttggtcgatgaggctaggaactccccacgggtgaccgtgtcctagcctgcgtggcggccaacccagcttctgctgggacgcctttttatggacatggtgtgaagactcgcatgtgcttggttgtgactcctccggcccctgaatgcggctaaccttaaccccggagccctgtgttgcaatccagtaacattagggtcgtaatgagcaatttcgggacgggaccgactactttgggtgtccgtgtttctcatttttcttattattgtcttatggtcacagcatatatataacgtatatactgtgatc

SEQ ID NO: 66 - DNA, 635 bp, Human enterovirus C105
  strain PER153 polyprotein gene, complete1
cccctaggatccactggatgttagtacactggtatcgcggtacctttgtacgcctgttttatatccccttccccgcaactttagaagtatcaaaagtaccgctcaatagccgccacgctcccagtgtggtttcgagcaagcacttctgttttcccggttgcgtcccatatgctgtgcaaacggcaaaaagggacaatatcgttacccgcttgtatactacgggaaacctagtaccgccattgattgtattgagggttgcgctcatcacctttcccggtgtagctcaggctgatgaggctcagaatcccccacaggtaactgtgtctgagcctgcgttggcggcctgccctcgccttatggcgtgggacgctcactacatgacatggtgcgaagagtctactgtgctatacaagagtcctccggcccctgaatgtggataatcctaaccactgatcccacgtacgcaaaccagcgtgtagtgggtcgtaacgcgcaagtcggtggcggaaccgactactttgggtgaccgtgtttcctttattacctattgaatgtttatggtgacaattgtttgattcagttgttaccatttgctacattcaataacctagtgtcaaaccgattgaattgctaca

SEQ ID NO: 67 - DNA, 636 bp, Turdivirus 2
  strain 10717, complete genome.1
cctcggtccctctttccgtcgccgcccacgacgttaaatgcggtgttgtggtgcttaggtgccacaccactgctatttgggtccccctttcccctatatatgtttgtttgtttatttcaatttcttgaggattggcacctccttatgccaaatctaaatcgtggaggatcccaggctttctggtctttaacagaactccacgtccaggtcatagaaactggttggtaggctgcctgagtagtccatttgctagtagtcccttgtgaacagggtggctcccgtttactgctggtattcccggtgtaggtcgccatggtggtaacaccatcctgcattgtgtgtgaaccagtaccgcaaggatagcaaggtatgaacacttgtggacgaaatggtaagtgatcaattcactttcatggccggaaggtcacgtggcaatcatgccacccaggtaccctcctctgggaggatctgagggtgggctaagcagaccctgccatgtggctgaacttttcccttattgttttactttgtaacatttatagttgtgttagtgatttgtgtgttgtgcccttgtgagctatatccagtataagttcgcagctagaagttaatccttcgacatcggctgtattggaa

SEQ ID NO: 68 - DNA, 636 bp, Human parechovirus 1
  strain VEN/2018-23121B, complete genome.1
ccctttcccagccctgagacggctggctaataaaagtctcacctgtaactaacatctaagacaatcatgtataaccttgtgcctggtccccaccagtcgaaagtatcttgcaataagataggtggatcaaggatgcttaaagcacaaagacaattaacttttctaacccacaagttgttgtggggtggtagatggcgtaccataactctactagtgagataccacgcttgtggaccttatgctcacacagccatcctctagtaagtttacaaggcgtctggtgatgtgtgggaacttattggaagcaatattttgccgaaaggcatccattagccagcggaataacacctggtaacaggtgcctctggggccaaaagccaaggtttagcagaccctaatggattggttcaaacctggaatattgtggaaaatatttagtacctacggatctggtagcagtgtaaacactagttgtaaggcccacgaaggatgcccagaaggtacccgtaggtaacaagagacactatggatctgatctggggccagctacctctatcttggtgagttggttaaaaaacgtctagtgggccaaacccaggggggatccctggtttcctttacttaaccgggatcact

SEQ ID NO: 69 - DNA, 636 bp, Human enterovirus C105
  strain USA/OK/2014-19362 polyprotein gene,1
cccctaggatccactggatgtcagtacactggtatcgtggtacctttgtacgcctgttttatacccccttccccgcaactttagaagcatcaaaagcaccgctcaatagtcaccacacccccagtgtggtttcgagcaagcacttctgttttcccggttgcgtcccatatgctgtgcaaacggcaaaaagggacaatatcgttacccgcttgtatactacgggaaacctagtaccaccattgattgtgttgagagttgcgctcatcacctttccccggtgtagctcaggccgatgaggctcagaatcccccacaggtgactgtgtctgagcctgcgttggcggcctgccctcgccttatggcgtgggacgcttgatacatgacatggtgcgaagagtctactgtgctatgcaagagtcctccggcccctgaatgtggctaatcctaaccactgatcccacgcacgcaaaccagtgtgtagtgggtcgtaacgcgcaagtcggtggcggaaccaactactttgggtgaccgtgtttcctttattacttattgaatgtttatggtgacaattgtttgattcagttgttgccattctctacattcatttacccagcatcaaaccaattgaactgttaca

SEQ ID NO: 70 - DNA, 637 bp, Turdivirus 2
  strain 007167, complete genome.1
cctcggtccctctttccgtcgccgcccacgacgttaaatgcggtgctgtggtgcttaggtgccacaccactgcggtttgggttcccctttcccctatatatgtttgtctgtttatttcaaattcttgaggattggcacctccttatgccaaatctaaatcgtggaggatcccaggctttctggtctcaaacagaactccacgtccaggtcataggaactggttagtaggctatttgagtagtccgtttgttagtaatgccttgtgaacagggtggctcccgtttactgctggtattcccggtgcaggttgccgtggtggtgacaccatcctgcattgtgtgtgaaccagtaccgcaaggatagcaaggtatgaacacttatgggtgaaataataagtgactaatccactttcatggccggaaggtcatgtggcaatcatgccacccaggtaccctcttaggaggatctgagggtgggctaagcagaccctgccatgtggctgaaattttctattattttattccataacatttatagctatataggtgttttgtgtgttgtgctctccttttccgagttatttccagtactagttcgcagctagaagtttaactcttcgatatcggctacattggaa

SEQ ID NO: 71 - DNA, 637 bp, Human enterovirus C105
  polyprotein gene, complete cds.1
ttcccacccctaggatccactggatgttagtacactggtatcacggtacctttgtatgcctgttttataacccctcccctgcaactttagaagtatcaaagacactgctcaatagccgccacacctccagtgtggtttcgagcaagcacttctgttctcccggttgcgtcccatatgctgtgcaaacggcaaaaaggggcaatatcgttacccgcttgtatactacgggaaacctagtaccatcattgattgtgttgagggttgcgctcatcacccttccccggtgtagctcaggtcgatgaggctcagaatcccccacaggtgactgtgtctgagcctgcgctggcggcctgccctcgcctcacggcgtgggacgctcaatacatgacatggtgcgaagagtctactgtgctatacaagagtcctccggcccctgaatgtgtcctaaccactgatcccacgtacgcaaaccagtgtatagtgggtcgtaacgcgcaagtcggtggcggaaccaactactttgggtgaccgtgattcccttattacttattgaatgtttatggtgacaattgtttgattcagttgttaccatttaccacattcatcaacctagtgtcaaaccgattaaactgctaca

SEQ ID NO: 72 - DNA, 638 bp, Human parechovirus 2
  strain LPZ04-2008 polyprotein gene, complete1
tctaggagagtccctttcccagccagaggtggctggttaaacaatacctaatgtaacaaaacatctaagactttgtaacccatacctggtctccacccgttgaaggcaactagcaataaaataggtgggcttagacgcttaaagtatggtgtaaacaatcttttctagcctgtgcctagcatagggtggcagatggcgtgccataactctattagtgagataccacacttgtggaccttatgctcacacagccatcctctagtaagtttgtgaggcgtctgatgacgtgtgggaacttattggaaataacagtttgctgaaaagcatctcattgccagcggatcaacacctggtaacaggtgcctctggggccaaaagccaaggtttaacagaccctttgagattggttcaaacctgaattgttatggaaaatatttagtacctgctgatttggtagcaatacaaacactagttgtaaggcccacgaaggatgcccagaaggtacccgtaggtaacaagtgacactatggatctgatttggggccaactacctctatcttggtgagttggttaaaaaacgtctagtgggccaaacccaggggggatccctggttttcttttattgtatcactatcact

SEQ ID NO: 73 - DNA, 644 bp, Human parechovirus 4
  clone V2A polyprotein gene, partial cds.1
ggatagatagtccctttcccagccttgaggcggctggtcaataaaagcctcaaacgtaactaacatctaagaagatttgtaaaccctatgcctggtctccactattcgaaggcaacttgcaataagaagagtggaattaagacgcttaaagcatagtgatagttttcttttctaacccacattcgtgtggggtggcagatggcgtgccataactctaatagtgagataccacacttgtggaccttatgctcacacagccatcctctagtaagtttatgagacgtctggtgacgtgtgggaacttattggaaacaacattttgctgcaaagcatcctattgccagcggaacaacacctggtaacaggtgcctctggggccaaaagccaaggtttgacagaccctttaggattggttctaaacctgaaatgttgtggaaaatatttagtacctgctgatctggtagtaatgtaaacactagttgtaaggcccacgaaggatgcccagaaggtacccgtaggtaacaagtgacactatggatctgatctggggctgactacctctatcttggtgagttggttaaaaaacgtctagtgggccaaacccaggggggatccctggtttcttttattttaacacagctaat

SEQ ID NO: 74 - DNA, 647 bp, Human parechovirus
  strain USA/TN/2015-OB2038, complete genome.1
cttaggagagtccctttcccagccttgaggcggctggccaataaaagcctcaaatgtaacaaacatctaagaagattgtgtggaaccctatgcctggtctccactattcgaaggcagcttgcaataagaagagtggaattaagacgctcaaagcatagagacaattttcttttctaacccatacttgtatggggtggcagatggcgtgccataactctaatagtgagataccatgcttgtggaccttatgctcacacagccatcctctagtaagtttgtgagacgtctggtgacgtgtgggaacttattggaaacaacattttgctgcaaagcatcctattgccagcggaacaacacctggtaacaggtgcctctggggccaaaagccaaggtttaacagaccctttaggattggttctaaacctgaaatgttgtggaagacacttagtacctgccgatctggtagtaatacaaacactagttgtaaggcccacgaaggatgcccagaaggtacccgtaggtaacaagtgacactatggatctgatctggggccaactacctctatcttggtgagttggttaaaaaacgtctagtgggccaaacccaggggggatccctggtttccttttattttatcattactaat

SEQ ID NO: 75 - DNA, 648 bp, Human parechovirus 14
  clone V10C polyprotein gene, partial cds.1
ggaggatagagtccctttcccagccttgaggcggctggtcaataaatgcctcaaatgtaactaacatctaagattaacttagacaaccctatgcctggtctccgctagtcgaaggcgccttgcaataagacgagtggaacaaagacgcttaaagcatagtgaaaatatacatttctaacctgtggcctccacagggtggcagatggcgtgccataactctattagtgagataccacacttgtggaccttatgctcacacagccatcctctagtaagtttgtaagacgtctgatgacgtgtgggaagttattggaagtaacaatttgccgtaaggcatcctagagccagtggattaacacctggtaacaggtgcccctggggccaaaagccaaggtttaacagaccctttaggattggttcaaacctgggttgttatggaagatatttagtacctgctgatttggtagtaatacaaacactagttgtaaggcccacgaaggatgcccagaaggtacccgtaggtaacaagtgacactatggatctgatttggggttgactacctctgtcctggtgagtcaattaaaaaacgtctagtgggccaaacccaggggggatccctggtttccttttattttattacaaccatt

SEQ ID NO: 76 - DNA, 649 bp, Human parechovirus 1
  isolate 450343, complete genome.1
ctctaggagagtccctttcccagccctgaggcggctggtcaataaaagcctcaatcgtaactaacatctaagaatattatttcaaccccatgcctggtctccactagttgaaggcaacttgcaataaaatgagtggaaacaagacgcttaaagcatggtgtaaattaccttttctaacctacactttgtgtggggtggcagatggcgtgccataattctattagtgagataccacgcttgtggaccttatgctcacacagccatcctctagtaagtttgcaagatgtctggtgacgtgtgggaacttattggaaacaacattttgctgcaaagcatcctactgccagcggaataacacctggtgacaggtgcctctggggccaaaagccaaggtttaacagaccctttaggattggttttaaaacctgaaatgttgtggaagatacttagtacctgccgatctggtagtagtgcaaacactagttgtaaggcccacgaaggatgcccagaaggtacccgtaggtaacaagtgacactatggatctgatctggggccaagtacctctatcttggtgacttggttaaaaaacgtctagtgggccaaacccgggggggatccctggtttccttttattttaccaatgccact

SEQ ID NO: 77 - DNA, 651 bp, Human parechovirus 8
  clone V8D polyprotein gene, complete cds.1
ctggaggatagagtccctttcccagccttgaggcggctggtcaataagagcctcaaatgcaacaaacatctaagactattgagaacaaccctgtacctggtccccactagtcgaaggcatctagcaataagatgagtggaatatgggcgcttaaagtacagagtcaatgatcttttctagcctacgcttatgcgtggggtggcagatggcgtgccataaccctattagtgagataccacacttgtggaccttatgctcacacagccatcctccagttagtttgtaagatgtctggtgatgtgtgggaacttgttggaaataacattttgctgtaaggcattcattagccagcggataaaacacctggtaacaggtgcctctggggccaaaagccaaggtttaacagaccctaatgaattggttcaaacctggaatgttatggaagatacttagtacctgctgatctggtagtaatgcaaacactggttgtaaggcccacgaaggatgcccagaaggtacccgcaggtaacaagagacactgtggatctgatctggggctagttgcctctttaaggtgaactagttaaaaaacgtctagtgggccaaacccaggggggatccctggtttcctttattatttgaatgttcatc

SEQ ID NO: 78 - DNA, 653 bp, Human parechovirus 5
  strain CH-ZJ1, complete genome.1
atttgctgagtttctctaggagagtccctttcccagccttgaggtggctggttaataaaacctcaagcgtaactaacatctaagacaaatttatcaaccccatgcctggtccccactagtcgaaagcaacttgcaataagatgagtggaacaaggatgcttaaagcatggtgcaaataaacttttctaacccatttacttggggtggcagatggcgtgccataactctattagtgagataccacgcttgtggaccttatgctcacacagccatcctctagtaagtttgtaagacgtctgatgacgtgtgggaacttattggaatctacaatttgccgaaaggcatcctactgccagcggaacaacacctggtaacaggtgcccctggggccaaaagccaaggtttaacagaccctttaggattggtgaaaacctgaattgtagtggaaaatatttagtacctgctaatttggtagtagtgcaaacactagttgtaaggcccacgaaggatgcccagaaggtacccgtaggtaacaagtgacactatggatctgatctggggctggctacctctatcttggtgagtcggttaaaaaacgtctagtgggccaaacccaggggggatccctggtttccctttatatcattatagct

SEQ ID NO: 79 - DNA, 654 bp, Parechovirus A
  isolate HPeV-1/CMRHP48/CMR/2014 polyprotein gene,1
ttgttacagttgaggcttccctttcccagccctgaggcggctggtcaataaaagcctcaactgtaacaaacacctaagattattacaataaccccatgcctggtctccactagttgaaggcaacttgcaataaaataagtggaaacaagacgcttaaagcatggtgtgaattaacctttctaacctgcactttgtgtggggtggcagatggcgtgccataattctattagtgagataccacgcttgtggaccttatgctcacacagccatcctctagtaagtttgtgagacgtccggtgacgtgtgggaacttattggaaacaacattttgctgcaaagcatcctattgccagcggaataacgcttggtaacaagcgcctctggggccaaaagccaaggtttaacagaccctttaggattggttcggaacctggaatgttgtggaagatacttagtacctgctgatctggtagtaatgcaaacactagttgtaaggcccacgaaggatgcccagaaggtacccgtaggtaacaagtgacactatggatctgatctggggccaggcacctctatcttggtggcctggttaaaaaacgtctagtgggccaaacccgggggggatccccggtttccttttatttgttcaaagtcact

SEQ ID NO: 80 - DNA, 663 bp, Human parechovirus 5
  isolate 174Chzj98, complete genome.1
gtacattagatgcgtcatctgcaactttagtcaataaattacctccaatgtcattaccaacattccctaccttttcactaacacctaagacaacaagtacctatgcctggtctccactattcgaaggcaacttgcaataagaagagtggaattaagacgcttaaagcatagagctagttatcttttctaacccacaaagttttgtggggtggcagatggcgtgccataactctattagtgagataccatgcttgtggatcttatgctcacacagccatcctctagtaagttgataaggtgtctggtgatatgtgggaactcacatgaaccattaatttaccgtaaggtatcctatagccagcggaatcacatctggtgacagatgcctctggggccgaaagccaaggtttaacagaccctataggattggtttcaaaacctgaattgatgtggattgtgtatagtacctgttgatctggtaacagtgtcaacactagttgtaaggcccacgaaggatgcccagaaggtacccgtaggtaacaagtgacactatggatctgatctggggccagctacctctatcatggtgagttggttaaaaaacgtctagtgggccaaacccaggggggatccctggtttccttttacctaatcaaagccact

SEQ ID NO: 81 - DNA, 664 bp, Human parechovirus 1
  isolate 550163, complete genome.1
ccgcattgctgagcttctctaggagagtccctttcccagccttgaggcggctggtcaataaaagcctcaattgtaacaaacacctaagcttatcatacaagccccatgcctggtctccactagtcgaaggcaacttgcaataagatgagtggaaacaagacgcttaaagcatggtgtaaattagcttttctaacccacatattgtgtggggtggcagatggcgtgccataattctattagtgagataccacgcttgtggaccttatgctcacacagccatcctctagtaagtttgtgagacgtctggtgacgtgtgggaacttatcggaaacagtattttgctgcaaagcatcctattgccagcgggacaacacctggtaacaggtgcctctggggccaaaagccaaggtttaacagaccctttaggattggtttaaaacctgaaatattgtggaagatacttagtacctactaatctggtagtagtgcaaacactagttgtaaggcccacgaaggatgcccagaaggtacccgtaggtaacaagtgacactatggatctgatctggggccaggtacctctatcttggtgacctggttaaaaaacgtctagtgggccaagcccgggggggatccccggtttccttttattttatcaatgccact

SEQ ID NO: 82 - DNA, 667 bp, Human parechovirus 1
  strain 16-G10, complete genome.1
gtaataatcttagatgtttgttacagttgaggcttttattgaccagccgcctcagggctgggaaagggactcaactgtaacaaacatctaagattattacattaaccccatgcctggtctccactagttgaaggcaacttgcaataaaatgagtggaaacaagacgcttaaagcatggtgtaaattaattttctaacccacattaagtgtggggtggcagatggcgtgccataactctactagtgagataccatgcttgtggaccttatgctcacacagccatcctctagtaagtttgtgagacgtctggtgacgtgtgggaacttattggaaacaacaccttgctgtaaagcatcctattgccagcggaacaacacctggtaacaggtgcctctggggccaaaagccaaggtttaacagaccctttaggattggttctgaacctgagatgttgcggaagatatttagtacctgccgatctggtagtaatgcaaacactagttgtaaggcccacgaaggatgcccagaaggtacccgtaggtaacaagagacactatggatctgatctggggtcaggtacctctatcttggtgacctggttaaaaaacgtctagtgggccaaacccgggggggatccccggtttccttttactttatcaatgccact

SEQ ID NO: 83 - DNA, 668 bp, Human parechovirus 1
  isolate SH1, complete genome.1
taccccgacttgctgagctcctctaggagagcccctttcccagccttggggcggctggtcaataaaagcctcaaatgtaactaacatctaagatagattataaccaccctatgcctggtccccactagtcgaaagcacctggcaataagacgagtggaataaggacgcttaaagcatagtgttagcatacacttctaacttgtgattttcacaaggtggcagatggcgtgccataactctatcagtgagataccacgcttgtggaccttatgctcacacagccatcctctaataagtttgtaagacgtctgatgacgtgtgggaacttattggaaacaacaatttgctgcaaagcatcctactgccagtggactaacacctggtaacaggtgcccctggggccaaaagccaaggtttaacagaccctttaggattggtatatacctgagttgttgtggaaaatacttagtacctactgatttggtagccggacaaacactagctgtaaggcccacgaaggatgcccagaaggtacccgtaggtaacaagtgacactatggatctgatctggggtcgaccacccctatccaggtgggtcgattaaaaaacgtctagtgggccaaacccaggggggatccctggtttccttttattttatcacagtcact

SEQ ID NO: 84 - DNA, 669 bp, Human parechovirus 5
  gene for polyprotein, genomic RNA, strain1
taccccgacttgctgagcttctctaggagagcccctttcccagccctgaggcggctggtcaataaaagcctcacacgtaactaacatctaagacaatcttatacaaccttgtgcctggtccccaccagtcgaaggcatctagcaataagataggtggaacaaggacgcttaaagcacaaagacaattaacttttctaactcacaatttgttgtggggtggtagatggcgtaccataattctattagtgagataccacgcttgtggaccttatgctcatacagccatcctctagtaagtttgtaaggtgtctggtgatgtgtgggaacttattggaaacaacattttgccgcaaggcatccattagccagcggaataacacctggtaacaggtgcctctggggccaaaagccaaggtttaacagaccctaatggattgatttaaatctggaatgttgtggaatatatttagtacctgctgatctggtagcaatacaaacactagttgtaaggcccacgaaggatgcccagaaggtacccgtaggtaacaagtgacactatggatctgatctggggctggatacctctatcttggtgatccagttaaaaaacgtctagtgggccaaacccaggggggatccctggtttccttttattttattactgccatt

SEQ ID NO: 85 - DNA, 672 bp, Human parechovirus 3
  isolate 651689, complete genome.1
cgtcgggccttataccccgacttgctgagcttctctaggagagtccctttcccagccagaggtggctggtcaaataatacctactgtaactaaacatctaagaaataacaaccacacacctggtctccaccagccgaaagcaactagcaataaggtgggtggatatagacgcttaaagtgtgttgtgcattttcttttctagcctgtgttttacacagggtggcagatggcgtgccataactctaatagtgagataccacgcttgtggaccttatgctcacacagccatcctctagtaagtttgtaagacgtctgatgacgtgtgggaacttgttggaaatagcagtttgctgcaaagcatcccattgccagcggatcaacatctggtgacagatgcctctggggccaaaagccaaggtttaacagaccccttgggattggttcaaacctgaactgctatggaaagcacttagtacctgctgatttggtagtaatgcaaacactagttgtaaggcccacgaaggatgcccagaaggtacccgtaggtaacaagtgacactatggatctgatctggggccaactacttctatctaagtgagttggttaaaaaacgtctagtgggccaaacccaggggggatccctggtttcctctcaattttaaacagtcact

SEQ ID NO: 86 - DNA, 673 bp, Avisivirus AVE052/AsV
  complete genome.1
gagctaatggggtccctatcttcatagccaagatccatagtggctcaggaaatagaggggggttcccagggtggattttccgaatcttagatttcggatatccgccttgggacaccccctttccccagccatgggttaaatggcccttcaccaggttaggtgctgtctaggcttccagtaaagaagtcactcgagctacgaacaaatcctaagagggaatggtggttagccccgtccactgggtgtctttcacccactttcagtggatcaatccaccccaactcccccctctatttcctgagccactatggatcttggctatgaagatagggaccccattagctccagtgccaagggatctcccccctcgtaagaggtgcccttgggcccaaaaggctagttggcaaggtgaagtgaaggaagctgctaacgtggtgaccttaagcggatcctgaagctgaccttggagtgaaaccctattggatggctgcgtgaagttgtggaggtggaaatggagaaagttggccgcttgtgagtagatgcccagaaggcataaggctgatctggggccagtgactataccgttccggtaaacctggtataaaaaccatgaaagcaaacgggttaaatttctctatttttattttctcttactgcagtgactacaggcaaa

SEQ ID NO: 87 - DNA, 674 bp, Human parechovirus 1
  isolate SH401, complete genome.1
ggccttataccccgacttgccgagtttctctaggagagtccctttcccagccgtgaggtggctggtcaataaaaacctcaaatgtaactaacatcaaagaaaaatcactcaaccccatgcctggcccccgctagtcgaaagcaacttgcaataagatgagtggaccaagggcgcttaaagcatggtgtcagcaatcttttctaacccatgtttcacatggggtggcagatggcgtgccataactctattagtgggataccacccttgtggaccttatgcccacacagccatcctctagtaagtttgtatgacgtccgatgacgtgtgggaacttattggaagcaacaatttgccgaaaggcatcctattgccagcggattaacacctggtaacaggtgcccctggggccaaaagccaaggtttaacagaccctttaggattggtttaaacctgaattgttgtggaagatatttagtacctgctgatttggtagtaatgcaaacactagttgtaaggcccacgaaggatgcccagaaggtacccgtaggtaacaagtgacactatggatctgatctggggctgactaccactatcctggtgagtcagttaaaaaacgtctagtgggccaaacccaggggggatccctggtttctttttattttataactgtcaat

SEQ ID NO: 88 - DNA, 677 bp, Human parechovirus 3
  isolate CHW014 polyprotein gene, complete cds.1
ggccgtcgggccttataccccgatttgctgagcttctctaggagagcccttttcccagccagaggtggctggttaaacaatacctattgtaacaaaacatctaagacataacaaccgtacacctggtctccactggccgaaggcaactagcaataaggtaggtgggttcagacgcttaaagtgtgttgtatatattcttttctaacctgtgttttacacagggtggcagatggcgtgccataaccctaatagtgagataccacgcttgtggaccttatgctcacacagccatcctctagtaagtttgtaagacgtctgatgacgtgtgggaacttgttggagataacattttgctgcaaagcatcccattgccagcggatccacatctggtaacagatgcctctggggccaaaagccaaggtttaacagaccctttgggattggttcaaacctgaattgttatggaagacatttagtacctgctgatttggtagtagtgcaaacactagttgtaaggcccacgaaggatgcccagaaggtacccgtaggtaacaagtgacactatggatctgatctggggccaactacctctatctaggtgagttggttaaaaaacgtctagtgggccaaacccaggggggatccctggtttccttttttaaatttgaataatcact

SEQ ID NO: 89 - DNA, 679 bp, Marmot sapelovirus 2
  strain HT6, complete genome.1
gggaaatacggggggggattacccccctcccgtatttccccctgttgcccgggggtagtgaacgatggatctacggatcctttgttcacagggccaaggttcaagcccacttttgtgagaagcatgctttactaggctatgggttgagtggcccataggcaaccctatgaagaggctacactcactacatccgccaacaggcccaggcgtatgtgggcctataagaaatgtacgttcgtccgcttatggtgcctaatccataggcatctaggacaagtacttctgtttccccggtcacgaggaatatgctgtacccacggcagaagccagacatgatcgttacccgactccgaactgtgcgaaacctagtaccttcaagtgaaacagagatcattgatccggggtgaccctgaccccagaaactcatgatgggtgtcgccgttccgacaggggagaccctgggcgtcgccgcgctggcatgagggcccattagggcatgatcaatgcggaccttgaggcgaagagtctagtgcgcttcggtttattcctccaggcccctgaatgcggctaatcctaaccccggagcgtatcacaccaatccaggtgctggtgcgtcgtaatgcgtaagtctgggatggaaccgactactttgggtgtcctgtgtttctaatttctcttg

SEQ ID NO: 90 - DNA, 680 bp, Human parechovirus 1
  isolate K150-93, complete genome.1
cgtcgggccttacaccccgacttgctggacttctctaggagagtccctttcccagccctgaggcggctggtcaataaaagcctcaattgtaacaaacatctaagcttattacaataaccccatgcctggtctccactagttgaaggcaacttgcaataaaatgagtggaaatgagacgcttaaagcatggtgtaaactaacttttctagcccacactttgtgtggggtggcagatggcgtgccataattctaatagtgggataccacgcttgtggaccttatgctcacacagccatcctctagtaagtttgtgtgacgtctggtgacgtgtgggaacttattggaaacaacattttgctgtaaagcatcctattgccagcggaacaacgcctggtaacaggtgcctctggggccaaaagccaaggtttagcagaccctctaggattggtttaaaacctgaaatgttgtggaagatacttagtacctaccgatctggtagtaatgcagacactagttgtaaggcccacgaaggatgcccagaaggtacctgtaggtaacaagcgacactatggatctgatctggggccaggtacctctatcttggtgacctggttaaaaaacgtctagtgggccaaacccgggggggatccccggtttccttttattttatcaatgccact

SEQ ID NO: 91 - DNA, 680 bp, Parechovirus A
  strain NIG13194, complete genome.1
cgtcgggccttataccccgacttgctgagcttctcgaggagagtcccttttccagccctgaggcggctggtcaataagagcctcaatcgtaacgaacatctaagactgtcaaatcaaccctatgcctggtctccactattcgaaggcaactagcaataagaagagtggatcaatagacgcttaaagcatagtgtacgtaaacctttctaacttgtgttatacacaaggtggcagatggcgtgccataattctattagtgagataccacgcttgtggaccttatgctcacacagccatcctctagtaagtttgtaaggtgtctgatgacgtgtgggaacttattggaaataatagtttgctgcaaagcatcctactgccagcggattaacatctggtaacaggtgcctctggggccaaaagccaaggtttaacagaccctttaggattggttcaaacctgaactattatggaagatacttagtacctgctgatttggtaacagtgcaaacactagttgtaaggcccacgaaggatgcccagaaggtacccgtaggtaacaagtgacactatggatctgatctggggctgactacctctatcttggtgagtcagtcaaaaaacgtctagtgggccaaacccaggggggatccctggttttcttttattttatctcttgcaat

SEQ ID NO: 92 - DNA, 681 bp, Human parechovirus 1
  strain KVP6 polyprotein gene, complete cds.1
cgtcgggccttataccccgacttgctgagcttctccaggagagcccctttcccagccctgaggcggctggtcaataaaagcctcatctgtaacaaacatctaagattatgacattaaccccatgcctggtctccactagttgaaggcaacttgcaataaaatgagtgggaacaagacgcttaaagcatggtgtaaatttgcttttctaacccacactttgtgtggggtggcagatggcgtgccataattctattagtgagataccacgcttgtggaccttatgctcacacagccatcctctagtaagttcgtgagatgtctggtgacgtgtgggaacttattggaaacaacattttgctgaaaagcatcctatcgccagcggaacaacacctggtaacaggtgcctctggggccaaaagccaaggtttaacagaccctttaggattggtttaaaacctggaatgttgttgaagatacttagtacctgccgatctggtaatagcacaagcactagttgtaaggcccacgaaggatgcccagaaggtacccgtaggtaacaagtgacactatggacctgatctggggctaggtacctctatcttggtgacctggttaaaaaacgtctagtgggccaaacccgggggggatccccggtttccttttaatttcatcaatgccatt

SEQ ID NO: 93 - DNA, 683 bp, Human parechovirus 5
  strain BR/53/2006 polyprotein gene, complete1
tggccgtcgggccttataccccgacttgctgagtttctctaggagagtccctttcccagccttgaggtggctggtcaataaaaacctcaactgtaactaacatctaagctgattttatagataccccatgcctggtccccactagtcgaaagcacctggcaataagatgagtggaaaagggcgcttaaagcatggtgttagtatacatttctaacctgtgactatcacggggtggcagatggcgtgccataactctattagtgagataccacgcttgtggaccttatgctcacgcagccatcctctagtaagcttgcaaggcgtctgatgacgtgtgggaactaattggaaatgacagtttgctgctaagcatcctattgccagcggatcaacacctggtaacaggtgcctctggggccaaaagccaaggtttaacagaccctttaggattggttcaaacctgaactgttgtggaagattctcagtacctgctaatttggtagttaggcaagcactagttgtaaggcccacgaaggatgcccagaaggtacccgtaggtaacaagtgacactatggatctgatctggggccagctacctctttcatggtgagttggtcaaaaaacgtctagtgggccaaacccaggggggatccctggtttcctttattttatcatagtcatt

SEQ ID NO: 94 - DNA, 692 bp, Human parechovirus 1
  strain 2-B9-TW, complete genome.1
agagcttggccgtcgggccttataccccgacttgctgagcttctctaggagagtccctttcccagccctgaggcggctggtcaataaaagcctcaattgtaacgaacacctaagacgataatgataaccctatgcctggtctccactattcgaaggcaccttgcaataagaagagtgggctcaagacgcttgaagcatagagtgcgttttcttttctaatccacacccatgtggagtggcagatggcgtgccataactctattagtgagataccatgcttgtggaccttatgctcacacagccatcctctagtaagtttgtaagacgtctggtgacgtgtgggaacttattggaaacaacattttgctgtaaagcatcctactgccagcggaacaacacctggtaacaggtgcctctggggccaaaagccaaggtttaatagaccctttaggattggtttaaaacctgaaatgttgtggaaaatatttagtacctgccaatctggtagtaatgcaaacactagttgtaaggcccacgaaggatgcccagaaggtacccgtaggtaacaagagacactatggatctgatctggggccagctacctctatcttggtgagttggttaaaaaacatctagtgggccaaacccaggggggatccctggtttccttttattttacctcaaatactatc

SEQ ID NO: 95 - DNA, 695 bp, Parechovirus A
  strain HPeV-1/RUS/Novosibirsk/NS12-N3567/2012,1
tctcctagagagcttggccgtcgggccttataccccgacttgctgagtttctctaggagagtccctttcccagccttgaggcggctggtcaataaaagcctcaaatataacgaacatctaagacaattaaacataccctatgcctggtctccactattcgaaggcaacttgcaataaggagagtggaattaagacgcttaaagcatggagacagtttccttttctaacccacattagtgtggggtggcagatggcgtgccataactctaatagtgagataccacgcttgtggaccttatgctcacacagccatcctctagtaagtttgcaagacgtctggtgacgtgtgggaacttattggaaacaacattctgctgtaaagcatcctaatgccagcggaacaacacctggtaacaggtgcctctggggccaaaagccaaggtttaacagaccctttgggattggttcaaacctggaatgttgtggaaaatacttagtacctgccgatctggtagtagtgcaaacactagttgtaaggcccacgaaggatgcccagaaggtacccgtaggtaacaagtgacactatggatctgatctggggctggatacctctatcttggtgattcagttaaaaaacgtctagtgggccaaacccaggggggatccctggtttctttttattttataatgtcact

SEQ ID NO: 96 - DNA, 696 bp, Human parechovirus 1
  isolate 164Chzj909, complete genome.1
gaaccattctacaacttctttagcggctttccgtgtttggtttgcaaccttagttgcaaaacatttgaaaacacttggccttgggtcaataaaagcctcaactgtaacaaacatctaagattattacattaaccccatgcctggtctccactagttgaaggcaacttgcaataaaatgagtggaaacaagacgcttaaagcatggtgtaaattaacttttctaacccacattttgtgtggggtggcagatggcgtgccataattctactagtgagataccacgcttgtggaccttatgctcacacagccatcctctagtaagtttgtgagatgtctggtgacgtgtgggaacttattggaaacaacattttgctgtaaagcatcctatcgccagcggaacaacacctggcaacaggtgcctctggggccaaaagccaaggtttaacagaccctttaggattggttttaaaacctgaaatgttgtggaagatacttagtacctgccgatctggtagtaatgcaaacactagttgtaaggcccacgaaggatgtccagaaggtacccgtaggtaacaagtgacactatggatctgatctggagctaggtacctctatcttggtgacctggttaaaaaacgtctagtgggccaaacccgggggggatccccggtttccttttattttatcaatgccaat

SEQ ID NO: 97 - DNA, 696 bp, Human parechovirus 5
  strain CT86-6760, complete genome.1
tcctagagagcttggccgtcgggccttatacccgacttgctgagtttctctaggagagtccctttcccagccctgaggcggctggtcaataaaagcctcaaatgtaactaacatctaagacatttatgattcaaccccatgcctggtccccactagtcgaaagcatctagccataagatgagtggactaaggacgcttaaagcatggagccaacaaccatttctaacccatgttttgcatggggtggcagatggcgtgccataactctactagtgggataccacgcttgtggaccttatgcccacacagccatcctctagtaagtttgtaagacgtctgatgacgtgtgggaaaacactagaaatattaacttgctgtaaagcatcctactgccagcggaatcacatctggtaacagatgcctctggggccaaaagccaaggtttagcagaccctttaggattggttcaatacctgagttaatatggaaagtgcttagtacctgctgacttggtagtagtgcaaacactagttgtatggcccgcgaaggatgcccagaaggtacccgtaggtaacaagtgacactatggatctgatctggggctggatacctctatcttggtgatccagttaaaaaacgtctagcgggccaagcccaggggggatccctggtttccctatttttattattatcact

SEQ ID NO: 98 - DNA, 697 bp, Parechovirus A
  strain HPeV-5/RUS/Novosibirsk/NS12-N3863/2012,1
tctcctagagagcttggccgtcgggccttataccccgacttgctgagcttctctaggagagcccctttcccagccttgaggcggctggtcaataaaagcctcaaacgtaactaacacctaagataaatctcataaccctatgcctggtccccactagtcgaaagcacctagcaataagatgagtggaccatggacgcttaaagcatagtgccaatatacatttctaacctgtggattcccatggggtggcagatggcgtgccataattctattagtgggataccacgcttgtggatcttatgcccacacagccatcctctagtaagtttgtaaggcgtctgatgacgtgtgggaacttatcggaaacaacaatttgctgcaaagcatcctattgccagcggacaaacacctggtaacaggtgcctctggggccaaaagccaaggtttaacagaccctttaggattggttcttacctggattgttgtggaaggtacttagtacctgctgatttggtagttggacaaacactagttgtaaggcccacgaaggatgcccagaaggtacccgtaggtaacaagggacactatggatctgatttggggtcacctacctctatcttggtgaggtgattaaaaagcgtctagtgggccaaacccaggggggatccctggtttccttttattttacacagacact

SEQ ID NO: 99 - DNA, 701 bp, Human parechovirus 3
  strain VGHKS 080217-2013, complete genome.1
ttttgaaaggggtctcctagagagcttggccgtcgggccttataccccgatttgctgagcttctctaggagagcccctttcccagccagaggtggctggcaaaataatacctactgtaacaaaacatctaagatgcaataaccacacacctggtttccactggccgaaggcaactagcaataaggcaggtgggttcagacgcttaaagtgtgttgtaaatattcttttctaacctgtgttctacacagggtggcagatggcgtgccataactctaatagtgagataccacgcttgtggaccttatgctcacacagccatcctctagtaagtttgtaagacgtctgatgacgtgtgggaacttgttggaaataacagtttgctgcaaagcatcccactgccagtggattcacatctggtaacagatgcctctggggccaaaagccaaggtttaacagaccctttgggattggttcaaacctgaactgttatggaagacacttagtacctgctgatttggtagtaatgcaaacactagttgtaaggcccacgaaggatgcccagaaggtacccgtaggtaacaagtgacactatggatctgatctggggccggctacctctatctaggtgagttggttaaaaaacgtctagtgggccaaacccaggggggatccctggtttctttttactttgagtagtcatt

SEQ ID NO: 100 - DNA, 702 bp, Human parechovirus 2
  complete genome.1
tttgaaaggggtctcctagagagcttggccgtcgggccttacaccccgacttgctgagtttctctaggagagtccctttcccagccagaggtggctggtcaaacaataccaaacgtaactaaacatctaagataacatagccctatgcctggtctccaccagttgaaggcatcttgcaataaaatgggtggattaagacgcttaaagcatggagtcaattatcttttctaactagtgatcttcactgggtggcagatggcgtgccataactctattagtgggataccacgctcgtggatcttatgcccacacagccatcctctagtaagtttgcaaggtgtctgatgaggcgtgggaacttattggaaataattacttgctgcgaagcatcctactgccagcggatcaacacctggtaacaggtgcccctggggccaaaagccacggtttaacagaccctttaggattggttaaaacctgagtaattatggaagatacttagtacctaccaacttggtaacagtgcaaacactagttgtaaggcccacgaaggatgcccagaaggtacccgcaggtaacaagagacactgtggatctgatctggggccacctacctctatcctggtgaggtggttaaaaaacgtctagtgggccaaacccaggggggatccctggtttccttattttagtgtaaatgtcatt

SEQ ID NO: 101 - DNA, 705 bp, Human parechovirus 8
  isolate BR/217/2006, complete genome.1
gaaaggggtctcctagagagcttggccgtcgggccttataccccgacttgctgagtttctctaggagagtccctttcccagccctgaggcggctggataataaaggcctcacatgtaacaaacatctaagacaaaataatttgccttgcacctggtccccactagttgaaggcatctagcaataagatgagtggaacaaggacgcttaaagtgcaatgatagttatcttttctaacccactatttatagtggggtggtggatggcgcaccataattctaatagtgagataccacgcttgtggaccttatgctcacacagccatcctctagtaagtttgtgagacgtctggtgacgtgtgggaacttactggaaacaatgctttgccgtaaggctttcattagccagcggaccaccacctggtaacaggtgcctctggggccaaaagccaaggtttaatagaccctaatggaatggttcaaacctggagcattgtggaaagtacttagtacctgctgatctggtagtaatgcaaacactagttgtacggcccacgaaggatgcccagaaggtacccgtaggtaacaagtgacactatggatctgatctggggccaactacctctatcttggtgagttggttaaaaaacgtctagtgggccaaacccaggggggatccctggtttccttttattttactttgtcaat

SEQ ID NO: 102 - DNA, 706 bp, Potamipivirus A
  isolate TSPV, complete genome.1
cttattttataagtttcttgcagttggcctttttcaacgtcgtggctgacgttaaaaagccacaattccacttaccttttaccttttatgtttaatgtttgttagttttgtgatctttaacaaatagatctaaataatttgttggtaaccaatctcggatgtttcggctgcattgtagtttatttatttcattttagttgtaggtggccactacgtcctggaatcatacatggtaacatgtacctcggcggttatccactattacgctaatctaagaatatttaaatgaaaatgtaagtgttacggctgactttgggcctgatagttaaatgctcgcactgacagatagtaccctcctttaggatcgattctgttacatgggatccattttggtgccccactgattcaacctctttgttgaaaaagagttagcatactacaaattttccaaacaaaaaccctttttaatgactacaacttatgattttatgaattttactgctcttgaaaaagatattttgacattgatcgctgtactgtttcagacattcattgcatccatttttgttggctactcctcacaaactcaaaacttttccacacgagaaaccttgtttattgaattttgcctttatattttggaacttgttgttggatttattgtttgcttaattattgacctcacacctgttttaaacactacaat

SEQ ID NO: 103 - DNA, 707 bp, Hepatovirus A
  isolate HAV/Human/CMRHP6/CMR/2014 polyprotein gene,1
ggtctctggagagttccggagtccctcttggaggtccatggtgaggggacctgatacctcaccgccgtttgcctaggctataggctatttttccctttcccttttccctgttttgtgtaaatattaattcctgcaggctcagggttctttaatctgtttctctataagaacactcattttcacgctttctgtctgctttcttccagggctctccccttgccctaggctctggccgttgcgcccggcggggtcaactccatgattagcatggagctgtaggagtctaaattggggacgcagatgtttgggacgtcaccttgcagtgttaacttggctctcatgaagctctttgatcttccacaagaggtaggctacgggtgaaacctcttaagctaatacttctatgaagagatgctttggatagggtaacagcggcggatattggtgagttgttaagacaaaaacctttcaacgccggaggactggctctcatccagtggatgcattgagtggattgtttgtcagggctgtctctaggcttaatctcagacctctctgcgcttagggcaaacattacttggccttaaatgggattctgtgagaggggatccctccattgactgctggacttttctttggggccttaggtagtgtttgcctctgaggtactcaggggcatttaggtttttcctcactctcaaataatt

SEQ ID NO: 104 - DNA, 707 bp, Human parechovirus 3
  strain BJ-C3174, complete genome.1
tttgaaaggggtctcctagagagcttggccgtcgggccttataccccgacttgctgagtctctctaggagagtccctttcccagccttgaggcggctggacaataaaagcctcaactgtaacaaacacctaagattattatattaaccccatgcctggtctccactggttgaaggcaacttgcaataaaatgagtggaaattagacgcttaaagtgtgttgtacatattcttttctaacctgtgttctacacagggtggcagatggcgtgccataactctaatagtgagataccacgcttgtggaccttatgctcacacagccatcctctagtaagtttgtaagacgtctgatgacgtgtgggaacttgttggaaataacagtttgctgcaaggcatcccactgccagcgggttcacatctggtaacagatgcctctggggccaaaagccaaggtttaatagaccctttgggattggttcaaacctgaactgttatggaagacatttagtacctgctgatttggtagtaatgcaaatactagttgtaaggcccacgaaggatgcccagaaggtacccgtaggtaacaagtgacactatggatctgatctggggccggctacctctatctaggtgagttggttaaaaaacgtctagtgggccaaacccaggggggatccctggtttctttttaatttgagtagtcact

SEQ ID NO: 105 - DNA, 708 bp, Human parechovirus 1
  complete genome.1
tttgaaaggggtctcctagagagcttggccgtcgggccttataccccgacttgctgagtttctctaggagagcccttttcccagccctgaggcggctggtcaataaaagcctcaaacgtaactaacacctaagaagatcatgtaaaccctatgcctggtctccactattcgaaggcaacttgcaataagaagagtgggatcaagacgcttaaagcatagagacagttttcttttctaacccacatttgtgtggggtggcagatggcgtgccataactctaatagtgagataccacgcttgtggaccttatgctcacacagccatcctctagtaagtttgtgagacgtctggtgacgtgtgggaacttattggaaacaacattttgctgcaaagcatcctactgccagcggaaaaacacctggtaacaggtgcctctggggccaaaagccaaggtttaacagaccctttaggattggttctaaacctgagatgttgtggaagatatttagtacctgctgatctggtagttatgcaaacactagttgtaaggcccatgaaggatgcccagaaggtacccgtaggtaacaagtgacactatggatctgatttggggccagatacctctatcttggtgatctggttaaaaaacatctaatgggccaaacccgggggggatccccggtttcctcttattctatcaatgccact

SEQ ID NO: 106 - DNA, 708 bp, Human parechovirus 4
  isolate K251176-02, complete genome.1
tttgaaaggggtctcctagagagcttggccgtcgggccttataccccgacttgctgagcttctctaggagagtccctttcccagccctgaggcggctggttaataatagcctcaagcgtaactaatatctaagaagattgtgcaaaccctatgcctggtctccactattcgaaggcaacttgcaataagaagagtggaatcaagacgcttaaagcatagagacagtattcttttctaacccacattactgtggggtggcagatggcgtgccataattctaatagtgagataccacgcttgtggaccttatgctcacacagccatcctctagtaagtttgtgagacgtctggtgacgtgtgggaacttattggaaacaacattttgctgcaaagcatcctactgccagcggaacaacacctggtaacaggtgcctctggggccaaaagccaaggtttaatagaccctttaggattggttctaaacctgagatgttgtggaaaatatttagtacctgctgacctggtagtaatacaaacactagttgtaaggcccacgaaggatgcccagaaggtacccgtaggtaacaagtgacactatggatctgatctggggccaaccacctctatcttggtgggttggttaaaaaacgtctagtgggccaaacccaggggggatccctggtttccttttattttatcatatttaat

SEQ ID NO: 107 - DNA, 708 bp, Human parechovirus 4
  complete genome, genomic RNA, strain T75-4077.1
tttgaaaggggtctcctagagagcttggccgtcgggccttataccccgacttgccgagtttctctaagagagtccctttcccagccttgaggcggctggtcaataaatgccttaaatgtaactaacacctaagattgctttaacaaccctatgcctggtctccactagttgaaggcatctagcaataaaatgagtggaatcaagacgcttaaagcatagtgccagcatgcatttctaacctgcagtttttgcagggtggcagatggcgtgccataattctattagtgagatactacgcttgtagatcttatgctcacacagccatcctctagtaagtttgtaagatgtctgatgacgtgtgggaacttattggaaataacaccttgctgtaaagcatcttattgccagcggaacaacacctggtaacaggtgcctctggggccaaaagccaaggtttaacagaccctttaagattggttcaaacctgaggtgttatggaaaatattcagtacctgctgatttggtagtaatgcaaacactagttgtaaggcccacgaaggatgcccagaaggtacccgtaggtaacaagtgacactatggatctgatctggggccaactacctctatcttggtgagttggttaaaaaacgtctagtgggccacacccaggggggatccctggttttcttttattacacaattgtcatt

SEQ ID NO: 108 - DNA, 709 bp, Human parechovirus 1
  isolate BNI-788St, complete genome.1
tttgaaaggggtctcctagagagcttggccgtcgggccttataccccgacttgctgagctcctctaggagagtccctttcccagccttgaggcggctggtcaataaaagcctcaattgtaacaaacatctaagattattatattaaccccatgcctggtctccgttagttgaaggcaacttgcaataaaatgagcggaaacaagacgcttaaagcatggtgtaaattaacttttctaacccacatcttgtgtggggtggcagatggcgtgccataactctattagtgagataccacgcttgtggaccttatgctcacacagccatcctctagtaagtttgtgagacgtctggtgacgtgtgggaacttattggaaacaacattttgctgtaaagcatcctattgccagcggaacaacacctggtaacaggtgcctctggggccaaaagccaaggtttaacaaaccctttaggattggttctaaacctgagatgttgtggaagatacttagtacctaccgatccggtagtagtgcaaacactagttgtaaggcccacgaaggatgcccagaaggtacccgtaggtaacaagcgacactatggatctgatctggggccaggtacctctatcttggtgatctggttaaaaaacgtctagtgggccaaatccgggggggatccccggtttccttttattttatcaatgccact

SEQ ID NO: 109 - DNA, 709 bp, Human parechovirus 1
  strain BJ-37359, complete genome.1
tttgaaaggggtctcctagagagcttggccgtcgggccttataccccgacttgctgagtctctctaggagagtccctttcccagccttgaggcggctggacaataaaagcctcaactgtaacaaacacctaagattattatattaaccccatgcctggtctccactggttgaaggcaacttgcaataaaatgagtggaaataagacgcttgaagcatggtgcaaatctacttttctaacccacactttgtgtggggtggcagatggcgtgccataattctattagtgagataccacgcttgtggaccttatgctcacacagccatcctctagtaagtttgtgaggcgtctggtgacgtgtgggaacttattggaagcaacattttgctgtaaagcatcctatcgccagcggaacaacgcctggtaacaggtgcctctggggccaaaagccaaggtttaacagaccctttaggattggtttaaaacctgaaatgttgtggaaaatacttagtacctaccgacctggtagtaatgcaaacactagttgtaaggcccacgaaggatgcccagaaggtacccgtaggtaacaagtgacactatggatctgatctggggccaggtacttctatcctagtgacctggttaaaaaacgtctagtgggccaaacccgggggggatccccggtttccttttattttactaatgctatt

SEQ ID NO: 110 - DNA, 709 bp, Human parechovirus 4
  genomic RNA, complete genome, strain:1
tttgaaaggggctctcctagagagcttggccgtcgggccttacaccccgacttgctgagcttctctaggagagcccctttcccagccttgaggcggctggtcaataaaagcctcacatataaataacatctaagaatagcttcataaccctacacctggtccccactagtcgaagacaacttgtaataagatgagtggaacaaggacgcttaaagtgtagtgaaaatattcctttctaacccatgcacctcatggggtggcagatggcgtgccataactctaatagtgagataccatgcttgtggaccttatgctcacacagccatcctctagtaagtttgtgagatgtccgatgacgtgtgggaacttattggaaacaacaatttgccgtaaggcatcctaatgccagcggattcacacctggtaacaggtgcccctggggccaaaagccaaggtttaacagacccgttaggattggtttaaacctgaattgttgtgaaagatactcagtacctgctgatttggtagtaatacaaacactagttgtaaggcccacgaaggatgcccagaaggtacccgtaggtaacaagtgacactatggatctgatctggggccaactacctctatcttggtgagttggttaaaaaacgtctagtgggccaaacccgagggggatcctcggtttctatttattttatatttgctaac

SEQ ID NO: 111 - DNA, 709 bp, Human parechovirus 6
  genomic RNA, complete genome,strain:1
tttgaaaggggtctcctagaaagcttggccgtcgggccttataccccgacttgccgagtttctctaggagagtccctttcccagccctgaggcggctggtcaataaaagcctcaaacgtaactaacatctaagattgatttaataacaccatgcctgatccccaccagtcgaagacaactagtaataagacgggtggaataaggatgcttaaagcatggcgtaaatattcttttctaacccatgatttcatggggtggcagatggcgtgccataactctattagtgagataccacgcttgtggaacttatgctcacacagccatcctctagtaagtttgtgagatgtctaatgacgtgtgggaacttattggaagcaacaatttgccgtacggcatcctactgccagcggattcacacctggtaacaggtgcccctggggccaaaagccaaggtttaacagaccctttaggattggttaaaacctgaattgttgtggaagatactcagtacctgctgatttggtagtaatgcaaacactagttgtaaggcccacgaaggatgcccagaaggtacccgtaggtaacaagtgacactatggatctgatctggggccaactacttctatcatggtgagttggttaaaaaacgtctagtgggccagacccaggggggatccctggtttccttttttatttcactacagccaat

SEQ ID NO: 112 - DNA, 709 bp, Unknown
  Description of Unknown: polyprotein [echovirus 22 EV22, Harris, Genomic RNA Complete, 73391 sequence
tttgaaaggggtctcctagagagcttgcctagggccttataacccgacttgctgagcttctataggaaaaaaccctttcccagccttggggtggctggtcaataaaaacccccatagtaaccaacacctaagacaatttgatcaaccctatgcctggtccccactattcgaaggcaacttgcaataagaagagtggaacaaggatgcttaaagcatagtgtaaatgatcttttctaacctgtattatgtacagggtggcagatggcgtgccataaatctattagtgggataccacgcttgtggaccttatgcccacacagccatcctctagtaagtttgtaaaatgtctggtgagatgtgggaacttattggaaacaacaatttgcttaatagcatcctagtgccagcggaacaacatctggtaacagatgcctctggggccaaaagccaaggtttgacagacccattaggattggtttcaaaacctgaattgttgtggaagatattcagtacctatcaatctggtagtggtgcaaacactagttgtaaggcccacgaaggatgcccagaaggtacccgcaggtaacaagagacactgtggatctgatctggggccaactacctctatcaggtgagttagttaaaaaacgtctagtgggccaaacccaggggggatccctggtttccttttattgttaatattgacatt

SEQ ID NO: 113 - DNA, 712 bp, Human parechovirus 1
  strain USA/TN/2016-23032, complete genome.1
cacatgagttatctgatgtcctctagcccatgttggtgtccactcatgtgtttccaatctaaccagtctaggagagtccctttcccagccttgaggcggctggtcaataaaaacctcaattgtaacaaacatctaagattattacattaaccccatgcctggtctccactagttgaaggcaacttgcaataaaatgagtgggaacaagacgcttaaagcatggtgtgaattaattttctaacccacatcgagtgtggggtggcagatggcgtgccataactctactagtgagataccatgcttatggaccttatgctcacacagccatcctctagtaagtttgtgaggcgtctggtgacgtgtgggaacttattggaaacaacaccttgctgtaaagcatcctattgccagcggaacaacacctggtaacaggtgcctctggggccaaaagccaaggtttaacagaccctttaggattggttttgaacctgagatgttgcggaagatatttagtacctgccgatctggtagtaatgcaaacactagttgtaaggcccacgaaggatgcccagaaggtacccataggtaacaagtgacactatggatctgatctggggccaggtacctctatcttggtgacctggttaaaaaacgtctagtgggccaaacccgggggggatccccggtttccttttactttattaatgccact

SEQ ID NO: 114 - DNA, 713 bp, Rosavirus C
  strain NCGX12IN polyprotein gene, complete cds.1
ggaccggcgctcacccgtttcgacgagtgaccgcctaggattctctctgcccttgctttggacgcccgccacggcgttaaactggcacttcccctcacccctaccctgtaactaagtttgcacctcgcccagacaggctgctaagacgcttgttgctacagtatgtctggatccgcgagttctccttaagaaatcttttccacctccgccggtgcctatgccggtcgagacgggttaggaccccgttggctcaggccagagacaatcggtagtagtctttctactctcgcccatgccggttgtcacaccctcactagtcttaccaaggttgtaaattgtctgtgaaagctttacatgaactctgctgtgttgtagcgatggatgtgttgtgagcggatttccccacgtggtaacacgtgcctctcagaccaaaagtcacggtgttaacagcacccgcacatctggctgccttcccccgcagcccacagctttgtgattgtttagttagtaacggaacatttggcaatcctgaactaaggttagtgcaacggctaaggatgccctgaaggtacccgcaggtaacgttaagacactgtggatctgatcaggggccctcggtgcgcgtgctttacacgcgtagccagggttaaaaaacgtctatgccgtttcccccccgggagggggggttccttacccccatcacaattggcatt

SEQ ID NO: 115 - DNA, 717 bp, Penguin megrivirus
  isolate KGI-Bel-P5/2015, complete genome.1
gtttgggggggcgttcccccaggggctcctttccggtgtgaggcttggcaacctcatatcgttactctgccgaccagtctgggtcgtgtggccacacaatgggattcgttctgttgtgtagagtcacatggcattactgggctgatcggtggggatccgttgccacccctaaacccttacatttactggactgcttttcttggccccggaatgattcgctcacccgcgatgaggactgttgttcttattatggcaggattacgcgtctggtccgcgtaaggactaattcctatgtttatacgttactaccttgttctgaacggtgggcgccaccccgcctagtaggatcctggcttatcgtgtagacctctagggaccacattagctagagtgtaggctgctatggatggagtagtgacccctttttgggtatcactctctaagactccggaatgtgtcatagtacgctggaaatccttacttgtttttccatgagggggaggtggtgctgaaatattgcaagccacccctcggttaaaacagtttggtgccgcttatgccatattaccgccccttgtagttgggctgtttttgcagctccgggttagtagagtaccatagtggacgcggtgttgggaatcaccgccttggctgcacactgcttgatagagctgcggctggtcaagctaattgtggtataaccagttgatttggcat

SEQ ID NO: 116 - DNA, 736 bp, Hepatitis A virus
  polyprotein gene, complete cds.1
ttcaagaggggtctccggggatttccggagtccctcttggaagtccatggtgaggggacttgatacctcaccgccgtttgcctaggctataggctaaattttccctttccccttccccttccttgttttgattgtaaatatcaattcctgcaggttcagggttcttaaattggcattaaatttgtttctctataagaacactcaattttcacgctttctgtcttctttcttccagggctctccccttgccctaggctctggccgttgcgcccggcggggtcaactccatgattagcatggagctgtaggagtctaaattggggacacagatgtttggaacgtcaccttgcagtgttaacttggctttcatgaatctctttgatcttccacaagaggtaggctacgggtgaaacctcttaggctaatacttctatgaagagatgctttggatagggtaacagcggcggatattggtgagttgttaagacaaaaaccattcaacgccggaggactgactctcatccagtggatgcattgagtggattgactgtcagggctgtctctaggcttaattccagacctctctgtgcttggggcaaacatcatttggccttaaaaggggttctgtgagaggggatccctccattaacagctggactgttctttggggccttatgtggtgtttgccgctgaggtactcaggggcatttaggtttttcctcattctcaaataata

SEQ ID NO: 117 - DNA, 737 bp, Hepatitis A virus
  strain HAS-15, complete genome.1
cttcaagaggggtctccggaggtttccggagcccctcttggaagtccatggtgaggggacttgatacctcaccgccgtttgcctaggctataggctaaatttccctttccctgtccttcccttatttccctttgttttgcttgtaaatattgattcctgcaggttcagggttctttaatcatgtttccctataagaacactcaattttcacgctttctgtcttctttcttccagggctctccccttgccctaggctctggccgttgcgcccggcggggtcaactccatgattagcatggagctgtaggagtctaaattggggacgcagatgtttgggacgtcaccttgcagtgttaacttggctctcatgaacctctttgatcttccacaaggggtaggctacgggtgaaacctcttaggctaatacttctatgaagagatgctttggatagggtaacagcggcggatattggtgagttgttaagacaaaaaccattcaacgccggaggactggctctcatccagtggatgcattgagtggattgattgtcagggctgtctctaggtttaatctcaagacctctctgtgcttagggcaaacaccatttggccttaaatgggatcctgtgagagggggtcccctccattgacagctggactgttctttggggccttatgtggtgtttgcctctgaggtactcaggggcatttaggtttttcctcattcttaaacaata

SEQ ID NO: 118 - DNA, 742 bp, Enterovirus C
  strain WIV14, complete genome.1
ttaaaacagctctggggttgcacccaccccagaggcccacgtggcggctagtactccggtaccacggtacccttgtacgcctgttttatactcccttcctccgcaatttagaagctcatgatcaagttcaataggagggggtacaaaccagtaccaccacgaacaagcacttctgtttccccggtgatgttgtatagactgctcgcgcggttaaaagcgacggatccgttatccgctcatgtacttcgagaagcctagtattacctcgggatcttcgacgcgttgcgctcagcactcaaccccagagtgtagcttaggtcgatgagtctggacattcctcaccggcgacggtggtccaggctgcgttggcggcctatctatggctaacgccataggacgctagttgtgaacaaggtgtgaagagcctattgagctacatgagagtcctccggcccctgaatgcggctaatcccaacctcggagcaggcgatcacaagccagtgattggcctgtcgtaatgcgtaagtccgagacggaaccgactactttgggtgtccgtgtttccttttatttttatcatggctgcttatggtgacaatcagtgattgttgtcatagagcgaattggattggccatccggtgaaaacaaagtcaattactttctcacttgttggacctacacccgatacgctttacccccaagctaattaaaattattagaagttaggactacggtgtcaca

SEQ ID NO: 119 - DNA, 743 bp, Enterovirus C96
  isolate 184C5/SD/CHN/2009, complete genome.1
ttaaaacagcctgtgggttgttcccaccccagaggcccacgtggcggctagtacaccggtatcacggtacccttgtacgcctgttttatactccctaccccgtaacttagaagcaataatccaagttcaatagtaggggtacaaaccagtaccaccacgaacaagcacttctgtttccccggtgatatcgtatagactgtacccacggtcgaaaatggtggatccgttatccgcttttgtacttcgagaagcccagtaccatcttggaatcttcgatgcgttgcgctcagcactcgaacccggagtgtagcttaggccgatgagtctggacaatccccaccggcgacggtggtccaggctgcgttggcggcctacctgtggcccaaagccacaggacgctagttgtgaacaaggtgcgaagagcctattgagctacaaaagagtcctccggcccctgaatgcggctaatcccaaccatggagcaggtgatcacaaaccagtggtaagcctgtcgtaacgcgcaagtccgtggcggaaccgactactttgggtgtccgtgtttccttttatttttgtatggctgcttatggtgacaatcaaagattgttatcataaagcgaattggattggccatccagtgagagtaaagcacattatttacttgcttgttgggtttgcccctttgatttgtaacactctttatctaccttatattgtacttttggttagacaacagtatcacg

SEQ ID NO: 120 - DNA, 743 bp, Human poliovirus 1
  isolate HAI00003, complete genome.1
ttaaaacagctctggggttgcacccaccccagaggcccacgtggcggctagtactccggtattgcggtacccttgtacgcctgttttatactcccttcccgtaacttagacgcacgacaccaagttcaatagaagggggtgcaaaccagtaccaccacgaacaagcacttctgtttccccggtgatgttgtatagactgcttgcgtggtcgaaagcgacggatccgttacccgcttatgtacttcgagaagcccagtaccacctcggaatcttcgacgcgttgcgctcagcactcaaccccagagtgtagcttaggctgatgagtctggacgtcccccaccggtgacggtggtccaggctgcgttggcggcctacctatggcttacgccatgggacgctagttgtgaacaaggtgtgaagagcctattgagctacataagaatcctccggcccctgaatgcggctaatcccaacctcggagcaggtggtcacaaaccagtgattggcctgtcgtaacgcgcaagtccgtggcggaaccgactactttgggtgtccgtgtttccttttattttattatggctgcttatggtgacaatcacagattgttatcataaagcgaattggattagccatccggtgaaagtgagactcattatctacctgttcgctggattcgctccattgagtgtgtttactctaagtacaatttcaacagttatttttaatcagacaattgtaccata

SEQ ID NO: 121 - DNA, 744 bp, Human enterovirus C96
  isolate AFP809/GD/CHN/2011, complete genome.1
ttaaaacaagtctggggttgttcccaccccagaggcccacgtggcggccagtacaccggtatcacggtacccttgtacgcctgttttatactccctaccccgtaacttagaagcaacaatccaagttcaatagtaggggtacaaaccagtaccaccacgaacaagcacttctgtttccccggtgataccatatagactgtacccacggtcaaaaatggtggatccgttacccgcttttgtacttcgagaagcccagtatcatcttggaatcttcgatgcgttgcgttcagcactcgaacccggagtgtagcttaggtcgatgagtctggacaatcctcaccggcgacggtggtccaggctgcgttggcggcctacctgtggcccaaagccacaggacgctagttgtgaacaaggtgtgaagagcctattgagctacaaaagagtcctccggcccctgaatgcggctaatcccaaccatggagcaggtggtcacaaaccagtgactagcctgtcgtaacgcgcaagtccgtggcggaaccgactactttgggtgtccgtgtttccttttattttatgtatggctgcttatggtgacaatcaaagattgttatcataaagcaaattggattggccatccagtgagagtaaaacacattatctacttatttgttggatttgtccctttaattcatcacactcttcatctaatttacattgtggttctaattagacagcagtatcaca

SEQ ID NO: 122 - DNA, 744 bp, Unknown
  Description of Unknown: Human coxsackievirus A20strain IH35, complete genome.1
ttaaaacagctctggggttgtacccaccccagaggcccacgtggcggctagtactccggtattacggtacccttgtacgcctgttttatactccctccctcgtaacttagaagcacaaaaccaagttcaatagaagggggtgcaaaccagtaccaccacgaacaagcatttctgtttccccggtgatgttgtatagactgcccgcgcggttgaaagcaacggatccgttacccgctcaagtacttcgagaagcctagtattaccttggaatcttcgatgcgttgcgttcagcactcgaccctggagtgtagcttaggctgatgagtctggacgtccctcaccggtgacggtggtccaggctgcgttggcggcctacctatggctaacgccataggacgctagttgtgaacaaggtgtgaagagcctattgagctacttgagagtcctccggcccctgaatgcggctaatcctaaccatggagcaggcggtcacagaccagtgactagcttgtcgtaatgcgcaagtctatggcggaaccgactactttgggtgtccgtgtttccttttatttttattatggctgcttatggtgacaatcattgattgttatcataaagcgaattggattggccatccggtgaaagcgagacttactatttacttacttgttggacttaccacacttaatacatttattctaggtgtcacttgtatagcaattagaatcaaacagttgcatcata

SEQ ID NO: 123 - DNA, 744 bp, Poliovirus type 3
  mRNA (vaccine strain Sabin 3 (Leon 12a1b)).1
ttaaaacagctctggggttgttcccaccccagaggcccacgtggcggctagtacactggtatcacggtacctttgtacgcctgttttatactccctcccccgcaacttagaagcatacaattcaagttcaataggagggggtgcaagccagcgcctccgtgggcaagcactactgtttccccggtgaggccgcatagactgttcccacggttgaaagtgtccgatccgttatccgaccatgtacttcgagaagcctagtaccgctctggaatcttcgacgcgttgcgctcagcactcaaccccggagtgtagcttgggccgatgagtctggacagtccccactggcgacagtggctccagctgcgctggcggccgcgacctgtggcccaaagccacgggacgctagttgtgaacagggtgtgaagagcctattgagctacatgaagagcctccggcccctgaatgcggctaattctaaccatggagcaggcagctgcaacccagcagccagcctgtcgtaacgcgcaagtccgtggcggaaccgactactttgggtgtccgtgtttccttttattcttgaatggctgcttatggtgacaatcatagattgttatcataaagcgagttggattggccatccagtgtgaatcagattaattactcccttgtttgttggatccactcccgaaacgttttactccttaacttattgaaattgtttgaagacaggatttcagtgtcaca

SEQ ID NO: 124 - DNA, 746 bp, Human enterovirus 96
  isolate FIN05-2, complete genome.1
ttaaaacagcctgtgggttgtacccaccccagaggcccacgtggcggccagtacaccggtattacggtacccttgtacgcctgttttatactccctaccccgtaacttagaagcaataacttaagttcaatagtagggggtacaaaccagtaccaccacgaacaagcacttctgtttccccggtgacattgtatagactgtgcccacggttgaaaacgatggatccgttatccgctcttgtacttcgagaagcctagtaatactttggaatcttcgatgcgttgcgctcagcactcatccccagagtgtagcttaggccgatgagtctggacattcctcaccggcgacggtggtccaggctgcgttggcggcctacctgtggcccaaagccacaggacgctagttgtgaacaaggtgtgaagagcctattgagctacaagagagtcctccggcccctgaatgcggctaatcccaaccatggagcaggtgatcgcaaaccagcggttagcctgtcgtaacgcgcaagtctgtggcggaaccgactactttgggagtccgtgtttctctttatttttacttatggctgcttatggtgacaatcatagattgttatcataacgcgaattggattggccatccggtgatatacaaacacattgtttacctatttattgggtttacacctttaagttctttcactctacaccttactcgtgttgtgttattaaccagacagtggtgccaac

SEQ ID NO: 125 - DNA, 748 bp, Rabovirus A
  strain Wencheng-Rt38-1 polyprotein gene, complete cds.1
ggagttttagtggtgttccaacactatgcgccatgatgtgttctacggaacatgttatgacgtatctttcatctaccccaacccttgtgtcaaccgatacgcctacacaggtgggtaaagcaccggcccactgaatggaacaaaatgctaggtgcaaagtcaggcccataggccatcggtcgaagcccgcttgggaataagactgatggattaccctattctggcgcctgaccacttgtttcttttctgaatcacacacctgtgtgaacggtggacctgcaccgtaactcttctagcctactaccacacttgtggaactataggggcacaggaacttcaaccaagtgctgttggaatggagaaaataatccaatcctgaaacgtcatggatccacactctgtgtggggctactagcctgcggaacaacacatggtaacatgtgccccaggggccgaaagccacggtgataagatcaccctagtagtttgagattgtatcaatgttcatgtcttagtaaggggaggtgaaatctatctgtgacaccggattactggttgtcgtatagcggctgaaggatgtcctgctggtacctttagggaaccttaagagactattgatcgaagcaggagcctggttggtctctcccactccaggttaaaaaacgtctaggccgtggaaccgggcgggaggcccggttttcctcccaaaattataatattgtgtatggtgacaactgaaggcttaaca

SEQ ID NO: 126 - DNA, 751 bp, Rabbit kobuvirus
  isolate Berlin/Jan2011/0572, complete genome.1
ttgaaagaaactccgggtattaaccatacccggagttttggcagggtgttccaacctgtcctggccatgcatttatctacggatatttgcatgacccgctttctatcgccccaacaatcccctttgtaaccacaagctttactcaggctagcagcccgactagctgtttggaagaaaaggctagggcacacaccaacaacaccgaccccactggtcgaaggccgcttggcaataagactggtggaacagggtcgcctgtagttgtttggaacattctttctaatgactttgtcagcggtgctactcacaccgtaactcttctaccctatccccacgcttgtggaactaggaggggatgagtgattcaagtaagtactgtcagaatggtgaaaatgatctgattctgaaacgctatggatccatcgaaagatggggctacacgcctgcggaacaacacatggtaacatgtgccccaggggccgaaagccacggtgataggatcacccgtgtagtttgagatcatatcaatgttcatagtctagtaagatgatttgaaatctaactgagctgatggctaactgcttgtcttattgcggcctaaggatgtcctgcaggtacctttagataaccttaagagactattgatctgagcaggagccaaagtggtctttcccagctttggttaaaaaacgtctaagccgcggcagggggcgggaggccccctttcctcccaaaacttaatattgattgt

SEQ ID NO: 127 - DNA, 751 bp, Coxsackievirus
  A24 genomic RNA, complete genome, strain:1
gaaattaaaacagctctggggttgttcccaccccagaggcccacgtggcggctagtacactggtattacggtacccttgtacgcctgttttacacccctttcccccgtaacttagaagcttttaaattcaagttcaacagtgagtggtacaacccagtactactatgaacaagcacttctgttaccccggtgagattgcataagctgtccccacggctaaaagcgattgatccgttatccgctcttgtacttcgagaagcccagtaaaaccttgggatcctcgatgcgttgcgctcaacactcaaccccagagtgtagcttgggctgatgagtctgggcattcctcaccggcgacggtggtccaggctgcgttggcggcctacctgtggcccaaagccacaggacgctagttgtgaacaaggtgtgaagagcctattgagctacaagagagtcctccggcccctgaatgcggctaatcccaaccacggagcaggtgattgcaacccagcaactagcctgtcgtaacgcgcaagtctgtggcggaaccgactactttgggtgtccgtgtttccttttattacataatggctgcttatggtgacaatcatagattgttgtcataaagcgagttggattggccatccggtgagaattaaaacaattatttacttgtttgttggatttgttcctatacacacccatacaccttgcttgattgaagtaattctgttgataagacaacactattacg

SEQ ID NO: 128 - DNA, 752 bp, Salivirus A
  isolate BN-5, complete genome.1
tttcctcctttcgaccgccttacggcaggcgggtccgcggacggcttcggcctacccgcgacaagaatgccgtcatctgtccttatcacccatattctttcccttcccccgcaaccatcacgcttactcgcgcacgtgttgagtggcacgtgcgttgtccaaacagttacactcacacccttggggcgggtttgtcccgccctcgggttcctcgcggaaccctccctcttctctctccctttctatccgccttcactttccataactacagtgctttggtaggtaagcatcctgaccccccgcggaagctgccaacgtggcaactgtggggatccaggcaggttatcaaaggcacccggtctttccgccttcaggagtatccctgccggtgaattccgacagggctctgcttggtgccaacctcccccaaatgcgcgctgcgggagtgctcttccccaactcatcttagtaacctctcatgtgtgtgcttggtcagcatatctgaggcgacgttccgctgtcccagaccagtccagcaatggacgggccagtgtgcgtagtcgctttccggtttcccggcgcatgtttggcgaaacgctgaggtaaggttggtgtgcccaatgcccgtaatttggtgacacctcaagaccacccaggaatgccagggaggtaccccacttcggtgggatctgaccctgggctaattgtctacggtggttcttcttgcttccacttctcttttttctggcatg

SEQ ID NO: 129 - DNA, 754 bp, Sebokele virus 1
  ORF1 gene for polyprotein, genomic RNA, strain 1.1
gaaagggggccaccctgcccatagggcagggtccttcttggctgggtggctcgtatccactccatgggttgtgcctatccggtcatccccctttccccacagccggtgtgggttctaatcggctcctactaaacacctaagcatcactgcgcctctatctctcctatccacaggtctaagacgcttggaataagacatgtgggtgcaataggaagattagctagtccaatctctccttccagctacgcttctcccttcgatgagcgtagggggggcccccacctccctcatctctggatagggctcttgctacggggctttcccgtctggaccagcaggcccactggtgcgcttccattcaagtttagtgtgcattactgtctgaaatattgctttgctaggatctagtgtagcgacctgcatattgccagcggacttccccacatggtaacatgtgcctctgggcccaaaaggcatgtctttgaccgtatgcagtacaaccccagtataggtcctttctatggcagtatggatctcagtgatgagtctatacagaatatggaagtggttcggatatgtcagcccgaaggatgcccagaaggtacccgcagataaccttaagagactgtggatctgatctggggcccaccaccttcgggtgggtagaagctaaccatgccttgggttaaaaaacgtctaagggctgaccagacccgggggatccgggttttccctatcttgacctactctaatc

SEQ ID NO: 130 - DNA, 762 bp, Hepatovirus A
  isolate 18f.1, complete genome.1
tttccctttcccttttttcaagaagggtctccgggaatttccggagtccctcttggaagtccatggtgaggggacttgatacctcaccgccgtttgcctaggctataggctaaattttccctttcccttttccctttcctattccctttgttttgcttgtaaatattgatttgtaaatattgattcctgcaggttcagggttcttaaatctgtttctctataagaacactcatttcacgctttctgtcttctttcttccagggctctccccttgccctaggctctggccgttgcgcccggcggggtcaactccatgattagcatggagctgtaggagtctaaattggggacacagatgtttggaacgtcaccttgcagtgttaacttggctttcatgaatctctttgatcttccacaaggggtaggctacgggtgaaacctcttaggctaatacttctatgaagagatgccttggatagggtaacagcggcggatattggtgagttgttaagacaaaaaccattcaacgccggaggactgactctcatccagtggatgcattgagtggattgactgtcggggctgtctttaggcttaattccagacctctctgtgcttggggcaaacatcatttggccttaaatgggattctgtgagaggggatccctccattgccagctggactgttctttggggccttatgtggtgtttgccgctgaggtactcaggggcatttaggtttttcctcattcttaaataata

SEQ ID NO: 131 - DNA, 788 bp, Poecivirus BCCH-449
  polyprotein gene, complete cds.1
aggtcggtgctgtgacttttgtagttggattggatcctcactttgggtgaggttccactccaagtttgagtgttttgtgtgtgtgtgggcataattaattgtttattatgggaactacacaatcgcaacacgcgcaagtttgtagtttgattggcgtgcaaatgtcaaatcaagcatataacacaatttggtggctgttggtgtttgttataggaattttggttgtgttgaaattgtggatgtgtaggaaatatgcacaattacgtcagcgtcaggagttttataacctggcgcaacaccaaaatggtcttcgcgctttaacatcaccagcgaggtgtaaacaaattgaagttgaattagatcgtgtataggccagggaaccatccctcccaacgccacatcttgtggggaagttgggataatggtgggtctatatgaattggtctgtagacccacagtgaagagtgaatagtatgcttgcggttccatttgttaatggtctagcatgggtgggggcggcaaccccgtgaggggttccccactggccaaaagcccaggggttagtcatttcaaccaaggaagctggtaacctggtgacctgaacttgagtggtgagacccccttgctagagtgtgtaaaccgattgtaagcattttgtttgcttagtatctgtggtataagcagtcaattttgtataggctcaaggctgtggtagttagtagatgcccggaaggttattactgatccggggaccgtgactatacattaggtaaaccggtttaaaaacc

SEQ ID NO: 132 - DNA, 816 bp, Picornaviridae sp.
  isolate dwb062pic1nc genomic sequence.1
gttcagttgccatccccgttcgggtggtttctcacggctaggcggaagtccagcccattcaacgtgagtccgggagttgggatatccaaaaaggagtcccgttttacttacacaccctcatgtctagccacagagggactgtgcggtagccactccgcacaaacggaaaagaggccagaggggatactcccccctggaccccttttccgtttgtgcggagtggcgaccgcacaggcgttaggctgctaagtagtctgcaagtagcttgcccactctctggggacaaagttctctggattggggtaagtgaagtgcgtgggctaacttggtggctgtagcccggatctggccggcctatgaaaccacggatccgcttcttttccctataccttttcccgagtgtttgtctgcaacttgttaagtgatttcttggtttgtttgacacaatcgctttggattttgttcttattttggtattttgaccactctagtatttgtgttctacctgaaattcccttgcaaggggtgtagtagggtgttgctcgtactagttgtggactccctctgtggctagacatgagggtgtgtaagtaaaacgggactcctttttggatatcccaactcccggactcacgttgaatgggctggacttccgcctagccgtgagaaaccacccgaacggggatggcaactgaacctagtagggctcgtaggaggcttgcacatacaccagattgggaattctggtcttgctcatgactgggtgatagccttgcggcggatcaagtcacagttgtaatccgttgatttgcaccc

SEQ ID NO: 133 - DNA, 833 bp, Harrier picornavirus 1
  strain harrier/MR-01/HUN/2014, complete1
tttgacaacctggcaaccctatctctaggtaggatgctgtctttggcccccgcctcccccatcctcccgaccatatctctattgggatgtgttcgggtcgtcacggatccgacattcctaccggggtccttctggctacggctggtctgactttggtggatgtgtgacggtgtaattactttccggatcccactttcctattataactctttcatcccaaggttagggaaagaacctggctcggtaccaccagaccctccgccacgctagtggactctccggagataacggtaccccctttgtagtcacctgtgctggtgaagaaccacctagtattgcttgggtgcgtgccgcctagcttccatttcttctggagcactgtgcaatgaggtttccccacttggtaacaagtgcctcaggtcccgcaaggatactgtggggtggtgtgaccgcagggagctgtctccacggctcctctaatgttacgccgctatccacaggccagtgcgtgtcatcgatcccggatgacagagctagtattgcgaacccccaagtaagaaaagtggctagtaacctgatagctggtgaagagggtgggtcagttgagtagatgccctagaggtacccgaaaggatctgactagggacccgtgactatacattaggtaaaccgggtataaaaaccatgaaaaactgaccacttttcttttaacctcttctttctttttatgtgtgttaagtgttttgagtttggactgtaccttgcccgcctttcttggattttctctatcgctcttcttacacctactgttatcaaggcactctttagagata

SEQ ID NO: 134 - DNA, 894 bp, Equine Rhinovirus type 2
  genomic sequence.1
ttttgtaactgaggttttgacatctcattgtttttgagccccaacgtcttggtggatgctcaaagaagattactcttgatgcttggctctcagaaagaatggcacctcaatgttttgagacccgattcttttgagtcgagaccatttccccttccctgaagattgcttttcttccaactaaacccctattgatgtgttggtcgtttgccaatcggagggcgacaggcacaggtcgctccgagttctagtagtgtgggaacttgttactactgatgaaacgaggtagtgacactcagtacctgcgaacgaggtcggggccctcccttcttccttcacccaactttcacttttcgttccactttagcaggggtcttctttctatccccctggcggcattggaactagccgtcgcgtcttaacgcgcagccctgaaggccccacaccttgtggatcttgccgtgggtatgtttctggcatgtgtttctcaagcctgcaaccgaagccgaacagccacatgaacagtttgagcgtggtagcgctgtgtgagttggcggtggatccccctcgtggtaacacgagcccccgtggccaaaagcccagtgtttacagcacctctcacatccaggacgaccccatcctggcgctcactcttagtagtatggcttagtacgcattaggtggtaagccgagctctccctcggccttgttctgaatgcacacatgtctaggggctaaggatgtcctacaggtacccgcacgtaaccttcagagagtgcggatctgagtaggagaccgtggtgcactgctttacagatgcagcccggtttaaaaagcgtctatgcccctacagggtagcggtgggccgcgccctttccttttaaaactacttgttct

SEQ ID NO: 135 - DNA, 897 bp, Equine rhinitis B virus
  strain 303, complete genome.1
ttttgtaactgaggttttaacatctcattgtttttgagccccaacgtcttggtggatgctcaaagaagattactcttgatgcttggctctcagaaagaatggtacctcaacgtgttgagacccgattcttttgagtcgagaccactcccccttccccttgaaagattgcttttcttccaactaaacccctatcgatgtgttggtcgtttgccaatcggagggcgataggcacaggtcgccctacggtctagtagtgtgggaacttgccgctactgatgaaacgaggtagtgacacttagtacctgcgaacaaccctagggcaactcccttcttccttcacctacttttcctttccgttctgctttagcaggggtcttctttctatccccctggcggcattggaactagccgttgcgccttagcgcacagccctgaaggccccacaccttgtggatcttgccgtgggcatgtttctggcgtgtgtttctcaagcctgcaaccaaatgccgaacgggcacgtgaacagtttgagcgtggtagcgctgtgtgagttggcggtggatccccctcgtggcaacacgagcccccgcggccaaaagcccagtgttagcagcacctctcacatccagggaaaccccaccctggcgctcactcttagtaatgtgtcttagtacgcactaggtggtaagccgagctctccctcggtcttgtactgaatgcacacacgtctaggggctaaggatgccctacaggtacccgtacgtaaccttcagagagtatggatctgagcaggagaccgtggtgcgctgctttacagtcgtagcccggtttaaaaaacgtctatgcccctacagggtagcggtgggccgcgccctttcccttttaaaacttggtttc

SEQ ID NO: 136 - DNA, 1000 bp, Sicinivirus sp.
  strain RS/BR/2015/5R polyprotein gene, complete1
gggtgggatggatcccgttgcgtgcctgcagccgctcggtgtccatccttcctgttacccaccatgtctggtggtaccccccggtcccttccctatccccccatacagccgggacggaccacttacctccgggtctgtggcccaaccccgactcggggttgtggcggtggtcacagctccggctgtgacctcctaaccactcccttcacctactcccttatatagaaacttaagtttgactccccctatcccaaggtcttggctcatgccctttaaggctatctagcacaaacactctttgtttggcgtctggagacccactgagctaccactcatccgcgctcaatgtaacccccattagtattcgtgcaattttaatagtagttctgctccggcagcatctaagtgcccagggagcccaactggtgacagttgccctggggcccgaaaggctaggtggcaggggcccggtcaagcaaggggttcccaccctgagctgatcccgcggtcccgaagccaccctttggatggaggttccacacccgactgctatttcttttgcccggtgaacctggctggaaacatttagtttatggatttgttggtctgtggtgattagtagaccccctggaggtacccgtttggatctgaccagggacccgtgactatgccgttccggtaatccgggtttaaaaccatgaacgtcaccactcgctttcttttccttgttcttatttcttttatattgcaaactattagtgagaattcgtgttccctgacctctgcgtttggtctgcattctcagttattcagtttggctggtctggattgtttgtttagatgctcctagagcttctgctggttgttgtcacacttgttatagtcgttgcttctcccggcgagttttaccagttgcttgctatctgcacctacaacttcctgttgatctttctctggctagttggcttgattgaactttccaactatcctaccattcaac

SEQ ID NO: 137 - DNA, 1000 bp, Sicinivirus A
  isolate UT-G-Khajehnasiri, complete genome.1
atacctttaccttcccccactcactgatcggtgccaaccccaactccccagtgtcagatgcttttacaaactttatgctatggcgcgctggagtggcagtccacatttccacgtcggccagccccgctatggcaggagcgctactcgtggtggcatcacccgagggctttgaggacgtgcaacagcgcccatggaatgcgcaagttagcgggctaactacaatcccatatgtacttcttaacctgtgccaatccaattcagccactgtaatcctccctccttgtacagtcactccgtttgatgatgcccgctcccatacatcttggtctgtgcgcgtgtatgtcttcacacagctaaatgtccctaccggcgttgcaaatcaaatcacaattcaattgatgtttgctccccttgcttcccggtttttgtttgcatgtgttcccataaagcaccacctgcgcacccgcatactacccggttccggggatggctattcatttaacatcccccagaaccagggcgtccctatggctcaatatcttcctgaacatgagtccgcagactacatccctgggcattttgataattttgcacggtttgctaacgcccccgggctcttgcgcactgtgcgttggctctctgagtatactcccaacacacctcttcttcggcttaatttgaattctattagtctcggtcccgatacccacacccccttatcctatgtacttagtgcttttgctcaacaacgtgggtctctctcttttgatttggtgtttgttggggcccaggtccaatctgggcgcctgctcatatctataacccccccctcgcaggcccctcctgccagtgtcgaggaagccctccgtggccattccctgacctgggacgtgactgtgtcttgctgcagctcatttcacgcccccttcttctctgcgactgcctggcgatctctagctattgatggatccgctacaaaaactctctacaattcgtgggg

SEQ ID NO: 138 - DNA, 1000 bp, Cardiovirus B
  strain rat08/rCaB/HUN, complete genome.1
ccccacggtaaccccctttggacgcgggacctgcgatagtgccaaccccagcctttcctacacccgactcccgaccctaacccagggtcctcggaagaggatcatacatctcatcccctgaatgctgactaatcagaggaaagttagcattttccggcccaggctaagagaagtagataagttagattcaaattgatacaacatccccttgacgaattcgcaacgaaaagtcgtccctcacttgccgcttgatcacacccacgaactcacaattcggcccctcgtgacaagccccttgttgaaacgacctctttcaatgcgacgtggttggagatttgtcatcttacgactccgacgtaactaccgtcatgcctccccgattatgtgatgctatccgccctgctgggtggagcattctcgggttgagtaacctacatcctttactccttggactccggtcccccggtctaagccgcttggaatatgacagggttattttccaaacatcttctttctactcttaagtgttctatacttaagaagggtatgtgttgccccttccttcttggagaacgtgcgcggcggtctttccgtctctcgaaaagcgtgcgtgcaacatgcagagacctgtgaagaaagcagtctttgaactagccttagtgcagacaagaaactggctgtagcgacctcacactagcagcggacacccctcctggtaacaggagcccctgcggccaaaagccacgtggataggatccactggtgtgagcggtgcatccccagcaccctggtttcttggttgtactctggtgaacccagagatggcaatcttaagcaactctgtagagaagccaagaatgtccggaaggtaccccgcttcggtgggatctgatccggagactcgtccacagtgctctacactgtggctcgggtttaaaaactgtcacagcttctccaaaccaagtggtcttggttttccctttttactcattgtgtcacg

SEQ ID NO: 139 - DNA, 1000 bp, African bat icavirus A
  isolate PREDICT-06105, complete genome.1
aagcttgcttcaccagaattgctaggggcgaaccgacaacaccttgttgagtttccgtcccgagacaattcatacaagttccaagactcatgaagcaattggtgcgtactgacgattggtttggctcgagcacgtgttccgtccttgggataatacacaacgctaagtatccaagaaaggccttgtgtagtccctcacgattatgtcatgtctcgatgtcactccacgtggagtacaaacctctttccatctgtctaagcttttatggagtctcccacgattatgtgctctcaatcgtggttgtcgcgcggtctagttctcagcgcgaagtttaagctaagcaccctcgggcgttcccggattatgtgatcacatcaatttgatggctggtcaccacgcaacgcctggagagatactcttacttttctcttaagatccccggtcatttgacgcttgtaggatgatagggttattttccactataaatactttcatactcttggatgttctatatccaagacgggaggacctaccccgtaccccttagaggtgagatgccaagaacaggccctttctgttctctcgacaatggcatcataggcaacaagcatcacaccaagattgctaagttttgttaagagttcttcaagctatagggtggctgtagcgaccttctgatgcctgcggatttccccacggagcgatccgtgccacaggggccaaaagccacggctaacgcccatcaggagcggcacttaccccgtgccccacccttgaaacttgaatgttcacactggcttctctcggctttctgaactgtctgcttgttggggccccgaaggatgccctggaggtaccccattttatgggatctgaccaggggacacctcagctctctaagttgctggtgtttaaaaaacgtctaagggcccccaccccttaggtggagggatccacctttcctttattttttaaaactcttttatggtcacaattgttt

SEQ ID NO: 140 - DNA, 1000 bp, Aimelvirus 3
  strain gpai003, complete genome.1
actaacaggtgaaccctgtgagtttccggcccaggatttaggatgacatgttccaagtcagatgccaacgacttggtaaggacgaatttgcccgcattatgctacagttcccgcccgggacaactgacaccccattaagctacaacatggctgaaaagggtgttgggtccccccggattgtgtctgttcatagtgtgtgtaacgtggtttaccatctccactaacattggactaagcatttcatctttcctccccgattgtgtactcacttggctaacgctgggtggtcgcggttgggtccttgatttactttttctcgtctaagcattccaactgtcctccccgattatgtgctcattcagttaactgctgggtggtcatgactaacatcgaggaatcttctgtctacgcttactttgagctccggtcgcttgacgcttgtagggcgatagggttatcttcctgacaacatctttattctacctccataggctctatctatggagacggagtgtggcacccgtcccttctttgggagcttcggtagtgacgccctttgtcactctcgccagccgaggcatgcctggtgccaggtagcaaagaaagtatatgcttaaggacttgactgatttagcgcaagagtttgtagtgatgtccatagtgtctgcggatcccccacacggcgacgtgtgccgcggaggccaaaagccacggtgttcacagcacccctatggatgcccacagaccccagtgggcactcttgttgccggactttcaggaaattaggtataggctcttctcaaactcctggcattggactaggtaagaatgccccggaggtaccccagtactccttcgggagtctgggatctgaccgggggccccacaaacatgctttacgtgtttcgtgcggtcaaaaattgtctaactagtcccaaccttgaacaagggattgttctttccttttattactgagactggcctatggtgacaacagaga

SEQ ID NO: 141 - DNA, 1000 bp, Picornaviridae sp.
  rodent/CK/PicoV/Tibet2014 polyprotein gene,1
aatagagttttgccattctctaacttgtcaagatgggcacaatgatgctttgtttaacaaggctgatttttccttttgtaatatgagtggaattgtgttccactctattcttcttttatatacatcttatgtatgagactgactgcgtgtataagagaggtaagcaactaagacttgtaaccctcggagtgggttggaatgctgagctctacgcatgtggcgtagagacgatctcgggaatctgtctaaaagttgacataccgacctgtcgagactaataactcgattccattttaaatttccttcgtgttttagtcactttgtacacctaaaggggagtggcagtgggtctggatcctcattgttctgcaatgggttgtatcgctggtttaccacgtaagtccgcaaaaataggatcccatgttagagtgggaggaaggagcagtattagggctcctggccaaccctaaacaaagtgaatacattgtaaggtatgagtcatattactcaaccctttaaaggtgtaagtgttgatcttgtttcctggtaggctacgggtgaaaccaggagcgtagggagaccgtgaataatggtctttctgcaggggagacggaaatggtgtgaggtattccagtcatcgtttagatgccgtgtctaaatcactgtgccccatctgtaatcccaacatgcgacacccaaacttttaattgaatgggtagtttgatgagtgccccaaggtgtataggtcttgtgattgataaaaatgctatgcaggtaccaaatgctttcgcatgcgatctgagcataggtgggtgatcctgacccgtaattgttccctgtcaatcacgattcctctttctagtctaagctaggtttatggcacaatgtctaactatatgagattataagatattaacttacagaaatttagcagtcttattgtattttgttgctaacatactttcatttactgtctataattaatttagttctctttaaa

SEQ ID NO: 142 - DNA, 1000 bp, Picornaviridae sp.
  rodent/Rn/PicoV/SX2015_1 polyprotein gene,1
cacatcttatgatgataggtctgcacctctcataagtaagtgtgtgtgtgtataatacagggtaagcaactgagacttgtaatcctgtaggagtgagttggagtgctgggcctgttccatgtgggttcaggacgatctcgggaatctgcataacagttcgcataccgacctgccgagactaataactcggttccaattgtttgttatttttatcctttgggttttagtcgctttgtactcctagaggggagtggccgcgggtctgctccgcctttcgcctgagtgacaggcactggcgttggatgctggtttaccgcgtaagtccgcaaaaataggatcccatgttagagtgggaagaagaggaagtcttaggtcctctgcccaaccctaaacaaagcgaactacacgtaaggacagcggtagcgtggtaaccctatacacacgtaacgtttgatcttgccaaccagtaggctacgggtgaaactggttgcgactggccactgctaacgtggtgtctgggcaagggggaacggtaacgaagcaagatattccagaaccttagggtccgagtctaaattgctgtgccacggctgtaaccccggcatgcgaacgccaagtgtgtgtttgaatatcacgttatttaaatccccaagtgtagtagggattgattggtgataaaaatgctgcgaaggtaccaaggcaactaaaatggtaacccgggaggaatcttaggacgaattggctgagtcctaagtggaccgggttccaatttaggggcacctcagggtgcctgctgcgatctgatcgcaggtgagtgaacccgactcgtaattgttccctatcaccatcatctctctttctagtctaagtaggtttatggcacaataaaagctacatgaaagagatttaattgttgttgttgagttgttattactttcaaaataaccaattggcttttatttgttttctctgctgtttaatttgctgcaattagtttaca

SEQ ID NO: 143 - DNA, 1000 bp, Picornaviridae sp.
  rodent/Ds/PicoV/IM2014 polyprotein gene,1
ggccatggtaggtctgcacctcatggttcacaaaagtatggacatacaaatttagtataacaaaattgtgtgtgtgtataattgtaggtaagcaactaagacttgtaccttcaaggagtgagttggaatgctggcaccctgtcatgtgggcaggggtcgatctcgggaatctgcataagtgtttgcataccgacctgccagatttagtagtctggttcccaccggtttgttattttcttccttcgtgttttagtcgctttgtacacctaaaggggagtggcagcgggtctgctccgcttcggcgttggatgctggtttaccgcgtaagtccgcagaaataggatcccatgctagagtgggaggaaggagaagttttaggtctcctggccaaccctaaacaaagcgaacattgtgtaagtatgtaggctgcatgctaaccctttgtatgtgtaagtagtgatcttgtcaaccagtaggctacgggtgaaactggttgcgtttggcagctgtatccacggcatgccgagcaagggaaatggtaacggtgtgaggtattccatgacttcggtccgtgtctaaatcacagtgccccggctgtattcccgacatgcgctacccaagcatgcaattgaatagtatgtagttgaaatacccaaacaacgtagagtctagtgttgaataaaaatgctgcgaaggtaccaaagcggctcccaaaaattgaagccgggaggaagctagtggcaaatctggccccacgctgctagtggatcggcttctgggagtgtgaggggaaaccctcacggctgcgatctgatcgcaggtgaacaaacccagttcgtaattattccctgttcaacctaactctctttcttgtctaggctaggtctggcacaatgaaatgctatatgaaaagagttttataagagattttgtgttttgtgcgctttgtctgattctttcaggtttttactattaaagctagttataaagtaaatttgaa

SEQ ID NO: 144 - DNA, 1000 bp, Picornaviridae sp.
  isolate ybw202pic01nc genomic sequence.1
taacatttccaagtcagaccgtgaaatccatctcagtgggatgttttaggtctatcccaaagaccaaatgcagtttaacgacttgcaggtcggaaagagggatgcacgtacagggaacatagccctgaaaacgtgcaccccgctttccgacctgcaagtcgttaaactgcatttggtctttgggatagacctaaaacatcccactgagatggatttcacggtctgacttggaaatgttaacctggacttgagtttggattgtgattccccgggaatgtggagtacccggttaggcaggacttatttttactgcctctccaccttagtttatcacctccttatgaaggatccattagtactattatgatgaaaatggatgaatgggctagcgccagttagattgcctagagactacctccctggtaacagggactctagggcccaaaaggctaggtggtcggattagcaaccaagaaagggtttatgattaacccaatctgaacttgcgtcctaagccacccgtctaacccctgaccccgaggcattcatccactagtagttgtaatgtggaaagtgttggtcttttgtaaggatagtttaagctaagaaatcttggacccgtgggagtagatgccctggaggttattactgaccaggggaccgtgactatagcgttccgctaaaccggtttaaaaaccatgaaactatgggtccaagtgcttttcttaatcttattttactttaatggattgcattgacgaagttgattgtgcacagtgtgatcaaccatcgattaccttgagagtggtattgaaagtgattcaattttttgagtgtgcttttgaatgggtgcatcacctaccaaagactccagagatagtggaagaagtcaaagaagccaattgccatcagctagagaattcagaggattgagttgggaagaaaaaccttgcacacagttgacaaccaattgttgtaagggaggtcaattgattggaaa

SEQ ID NO: 145 - DNA, 1000 bp, Picornaviridae sp.
  isolate bs219upi03 genomic sequence.1
agaccgttgttcactctaaaccttctaaagccacaatgcggttggacaaacatggcaatctcggtcttccgggaaaacctaaactatctggcatacaacagatcgctgtaccgccatctcgcccgaaagctggttcaattcttgatgaacttttctctaaaggtcatccaggaattgtcaccaaaccacgtcctaccgggccaaatgctgttactgcggggtcatataaccctgcgcctgcacctgagtcctatgaagacttggctgctcgggctgctcgatatgccgctagtcgtatcggatcctgggcatctactcaatcccaggtacctaccagctgggacgaagatttggctaccgacgtcaccgacccctgcacatctgggcccggtgacctatctgtcaaatcagaacaagcaaatgatggtgatacagggtcgcacgtatctgtcggatcgaaaggatcagctgatgatctgccagaggatcaagtcatcctggtatcagacccacaaaccacgtgtctggaccaggttgactcctgctaatttgtcccgcccacccttctcctaccagggagtctacggtgccttcctcgccgtggatgacaccatatgggcagggccccaaatggtgccggtaccacacaagcttgtgatgtacctccttggaatgagtcaatctccccccaaccacctgaggcttgcacaaaccatcttagcctcagttcctttaacggaacgagctggtctcacccccgaaagcttgctggaatttgcagtggcctacctaaagcacctcaaggctgttccagtaaatctacgacacgaggatgatacaattgcacgccctgataactggctagctcctgacgtcccagtacccatggcagaaggggtgggtctctgggaagggcccgactttgccaatcggcccttttcgtcatagggggacggttctctgtcccccgctcataactggcttcactcccggtttattc

SEQ ID NO: 146 - DNA, 1000 bp, Enterovirus E3
  strain Papa, complete genome.1
ggtctggggcaaacattatcggtactgacaactctgttgtgctgtcgcggaaatatacatctttcccatggctgctaggttgtgctgccaactggatcctgcgcgggacgtcctttgtttacgtcccgtcggcgctgaatcccgcggacgacccttcccggggtcgattggggctctaccgcccccttctctgtctgccgttccggccgaccacggggcgcacctctctttacgcggtctccccgtctgtgccttctcatctgccggtccgtgtgcacttcgcttcacctctgcacgttgcatggagaccaccgtgaacgccccccggaacttgccaaaggtcttgcataagaggactcttggactgtcaacaatgtcaacgaccaggattgagacatacttcaaagactgtgtgttcaaagactgggaggagctaggggaggagattaggttaaaggtctttgtattaggaggctgtaggcataaattggtctgttcaccagcaccatgcaactttttcacctctgcctaatcatctcatgttcatgtcctactgttcaagcctccaagctgtgccttgggtggcttttgggcatggacattgacccttataaagaatttggagctactgtggagttactctcttttttgccttcggacttctttccgtctgtcagagatctacttgacaccgcatcagccctgtatcgggaagccctagaatcgccagaacattgttcacctaaccacacagcactcaggcaagctgttctgtgctggggtgagttaatgactctggcttcctgggtgggtaataatttggaggacccagcatctagggagttagtagttaactatgtcaataacaatatgggtctaaaaattagacaactgctgtggtttcacatttcctgtcttacttttggaagagaaacagttttagaatatttggtgtctttcggagtgtggattcgcactcctccagcttacagaccaccaa

SEQ ID NO: 147 - DNA, 301 bp, Daeseongdong virus 1
  isolate FTA2-2, complete genome.1
gtcatctataaggatgtcggtggtaaccccacaacggatgaccactgcaatcagtggcacgtgtaaagtcgagataaaataaacaaataagtgaaactctgctggatcctcacccgatccactaccgtaccactttcccaaatcttcagacgaaagaaatttttgtctgttcgctctgctcatcctaatccggtgagaataaacctgctcctcctaactcggggagtactaaactcgtcataatccgacgagaactgtcacttttaaccaaagtggtcaactgaattttcgcaaattcaaa

SEQ ID NO: 148 - DNA, 308 bp, Solemoviridae sp.
  isolate bsk136shi11 genomic sequence.1
gtaaatggttcaatgaatcatttaattctgcgcttttagatttagaccttgcttctgtacccggcgtaactaccttaagtcggtatggtaccacattaggagagatcttaggttttgacggtcaaacgttggatcctgagagagtggccatactgcgtcactatgtggtggacaggattcaggatcttttgcatgggaaacatgtagctgatcctattaaactgttcataaagcaggaacctcataaactgtcaaaaattgaagagggccgtttgcggttaatcagtgcagtatcagtagtcgatact

SEQ ID NO: 149 - DNA, 321 bp, Wenzhou tombus-like virus 17
  strain WZFSL82820 hypothetical protein1
aacaacaacaacaacaacaaccgcaacaagaaaccgcgtgcccctaggcgtggtaaccgcaacttggttgctgatcaggctatcaaggatgtccaacgtctccagggtgagttggacgcattaagggacgaaaaatcccaaaaagagcgagctcgagaacagaaggaacaggaacatgaagagctccgcgatgaaattaaagcgcgcttatctggcggctttaatattaaatgggatccacaagttcatcgtgtggaccgtagtcgtgtgtggcgagcgttagcttactgcatttgggtgcttgcaatcaccagtattgca

SEQ ID NO: 150 - DNA, 326 bp, Xingshan cricket virus
  strain XSXS-2 polyprotein gene, complete1
ctcaggtttagtgcttgcctccgctgcttttagcttgcttgtaggctgtttctttggacctgagtagcttatttgctaggcgatagttcgtgcttacttcttcggaagttactcttatttgatttctttcttcgcgacgagaggacggagccttgtctttcccttggaaagtttgcgtgtggtaacgcccacctgtaatcaaggacgctgctcccggctagggatccccgaccgtttaaaggttctacacattgctccgggtgtagaggtaggaagaaataaattttttcaaattaattcttgtttaagacttgaaaccggtaaaa

SEQ ID NO: 151 - DNA, 333 bp, Persimmon latent virus
  genomic RNA, complete genome, clone:1
gatttaaaccctggttttcttcatctttttgaaggagattttttagggttttaaatccctttctcagttgggtgttcgcactcgattgtttgagaccttcgggcggcctacgtcactacccattcgggtaggtacaggtttctgatctcttgaacttttgagtgcgttccatcaacccgagaaactggggacttgacccggatcctgatgcgtggcggtaaagaccgaagcaggattcggaccccaaggccctgagggagtggtagggaagaggtccggtgctctaaataaaaccctacgctcaacacccctcagggtgacgagcactgagcc

SEQ ID NO: 152 - DNA, 341 bp, Hubei sobemo-like virus 3
  strain WHBL72900 hypothetical protein 1,1
gagatgtttgcgtgggccgttgcgctgcgggcggcccacctccctacggggaccgtgagacaccgctggggaaggcccccacccccggccaaggggatcctgccgagaggcaggagaaagaggcccagccctctggggcgcctttaggggcgcctgggagggaagtacccgagccgggcggccggtcgggtgcggctgtgcagttcgaggctaaccgtaaggaaggcctgagctgcctcggcttgtcggaaaggaagacgaaggcacttatcaaggctttcaggaagcaggagcgcaattacagcgcgcgccgtgcggcctggattaaccgcatttggccg

SEQ ID NO: 153 - DNA, 346 bp, Arenavirus sp.
  isolate RtRe-AreV/Cs2008, partial genome.1R
tgttacagaactgtgtcccaaaatagataaccactatgcctaggatccccggtgcgcagccaaacacccttatttgtggattaaggtcaatgcttaacaaagtcaagtcaatgaaggtcctaaatactagaaggaagatgctcctactatttgatacatttatcctgatggctcatgtaagattcttcaaagaagagtcattgtatgcagaaacagagtggttaggttcatccttttgcagcgtcaatgataggctggtctccttagatgaaacggtgcagtctttgactaagtgggttagggccagacagagaaattactctaagaaagtgcctgagtgtgtgac

SEQ ID NO: 154 - DNA, 348 bp, Beet necrotic yellow vein virus
  isolate F72 RNA 4 segment, partial1
agttgattgtctgtaaaacaattccagttgtttgtctgtaaaacaaacatatatgcttgatcagctttgtagatccttgactatcaattttatttctatcattgaattcgaattgtttctgttgagattctctttacgatttgtgtcgtcatttcgtatattggaagacgggcctgattccagtattaattggtcagtttgtaggtgcagaacgcttttaagtgagacctaagactgcgtcggaaccttagattcacgagccgcgtgattaattgggtttgtcactgggatccagtctatcagtaaggggtaggttttttgttgagacttatctgattagtaacattt

SEQ ID NO: 155 - DNA, 362 bp, Wenling picorna-like virus 5
  strain WLJQ102796 hypothetical protein1
actgtgtagttgatttctagcacagcggtattaaaatttatcattgaatatatcataactatatttcggttttcactgagtataggatcctttactaggactcggggtgtcattgacgctttcgtaggtggatcacttgatagacgtcaatataaagttatcaatacagagaatcatttatgcgctgatttgtaatcggttcatatagcaatttatttatgcatagatctgtgatcagtgtatatagcacaatagggataatttgtgtacttttctgtgattagtacgcatagcaaaatttatagtattttgtgggattttctgtgattataccacatagcaaaatagttaagtatttgaac

SEQ ID NO: 156 - DNA, 367 bp, Yongsan picorna-like virus 3
  strain YPLV3/16-0052/ROK/20162
aacatgacccgatcgcacagttgaaacaatacaatgatgtcgtccagcgcccaaacggggggagagtaaaccggatgaaaacgaatgataccctatttgaagagctttggatcctgaagaacagcatggataagggagcacgatgaggaataagatccagtgcttcatccaataacaatgtcgggaacaggggagaagtttaaactctttggtagggtagatatgtctaattggaaggtgagtctccctagactagttgattgcggagacaatctaggataacggcaacggtagaataataaatgtagcgtgtccttaaggagcgcttgtatcgtccccaaatcagaaacataaacataaaacaaac

SEQ ID NO: 157 - DNA, 370 bp, Charcot virus
  isolate Antarctic66 maturation protein and1
gcctgaagaaaacgtcgggaaccccgacatccgtcaactatgcggatccttctaacctaaatactacggttaaggtccgtgcccgtatacagcccgttaacaaacgggatgggaagtacaatcatgttcgccaagaaattcgcgtcggtttcgaaacgaaacctcctcgcgcttgcgaacagagttgtgccacctctccagttgtgctcacccttgtttggagcgcgccggaaggtgtccaggccgatgtccctaaagcagtgttggacaaagtcctcgagcatatcgctcttggtactgctttcttggctggacctgatacacttgacgttgatacaacgctaactactaactaaatggagtaatactc

SEQ ID NO: 158 - DNA, 373 bp, Sanxia picorna-like virus 11
  strain SXXX37695 hypothetical protein2
aagcattgacacatatgtcattgccccggttatatgcttaagtgagtctactactcagactttaagagagaggagggcgatgcggtgtgcttgtttgagcgacagcacacatgaaatttagcttacaagtgatataacaattaaagagcaagagtgctcatcgtttgaaggtttagcgttaaaaccggatccagaagtgattggagtttcatcttttagtaatgaggcaggacaatgtgttgaagttaaggcttcggatagcttttattctgttaatcaggttgctgatttgcagtctgttaaggagtatttagctagacctaggctttttgacacttttgtgtttggtactagtcctggtgtggttacgacg

SEQ ID NO: 159 - DNA, 379 bp, Hubei sobemo-like virus 12
  strain spider127544 hypothetical protein1
ggcggtgtttgattacatcgtagcctcggcggagtttgtgagacagaagttgcagttgtcaccttatacttggtttcaactcatcctctgtttcttagtgctcctcccggcagttgccttttaccttagggtattttggtggctgttgagaacctcttggagattctcttgcggattgggacgttggttttgttacgttggatcatgcttgaaatggaatgttaagaaggtttttagggttttccggaaaactcccttacagtatgaaccggaggcctatgtcgctggatccgaatatgagcaagtgaaagaactgccagcttgtcagtttttgatcttaggaaatttggaatgcggtgacgttttgactccggttggt

SEQ ID NO: 160 - DNA, 384 bp, Picornavirales sp.
  isolate H1_Rhizo_26_FD_scaffold_168 hypothetical1R
tcatgaacccacagctcccgtattacggagctatataagtagttttactatgcgttagaaaacgacttaatgtattagttacaggattggtaactcgaagactatgagagtttaccgattatcggatacattattaaaagttctgcttaggtgcaaactaatcagatggaactataaaacgtcagattgatagtctatatccctaatctttaacgcgagcatgggatgaatataagcgttgctgaatcaaataatttaaaaataaatcagtcggaaaccactagcgagactattggaatcgtagactttaaacaggatggagaaattcatgaagcagaaatcaagaatgagattatgttggatcctactttaggacagactatt

SEQ ID NO: 161 - DNA, 386 bp, Beihai narna-like virus 19
  strain BHNXC41285 RNA-dependent RNA1
gtttgggctcagttttccctatttagggaagtgtacacggtgaggattcactgcgtagacaggatccactgcggcctggaccaccgtagttcctgtctacgatccttgaatcggatctgatgtgcacgtacgtctcagaggttttgcctaaaacgctctgatgcgcagtctgggttagctgcgcactcgaattatgacctgctaaccaaaaaggaaagcatgatcatgcggacggcgtgagcctgtccattgatcgagggcaactaaactgtttggaggacgttctctattcctatgagaacgtggttccaaacggcaggcgaccacccaatatcgacaagttaaaagaatgtcttgtcgatctccggaccctcagggtcaacggc

SEQ ID NO: 162 - DNA, 389 bp, Andean potato mild mosaic virus
  coat protein gene, complete cds.1
ttcgccaagctcatgatctgcgttgatgatggaagccttgaggacaaaaaactgtcttacttgtctgaattctcagtaggtcatctctccggcgactgcatccaagccatcttacctccatcgctcatcaagtatcagtcagcatgtcatgacttcttctgccacaattgcaccccatcccaaaaaatccttctcagcctggatcccatccctgagaacaagatccttcaactcctcctcaaagttcgttgggcttcacaggccttcttttcttaccttccccaaaaagccagagagttgctaatctctcgctccagccttccttcccttcactctgatcccaaaatctccctactagagtctgaattgcttccctttttcaattaatt

SEQ ID NO: 163 - DNA, 390 bp, Mossman virus
  complete genome.3
gacaaagggggcatgactgaccagtgctagtatacttatcccctgttcacaaatatggagtcagcagaatattcttttaaagaacagatcatgcaaacatcagccatctacttccatgataaatccagataatacagtgtgtatgtgtgtaaaagaccccccaaatcctatctgtacccttcacaagatgaatataatcctttcttcagccatatattctctatgcctaatagttgatctccatgaagtacaagatttagaccgtaatgtaatactgtcctttgtcatttttgttcccacagaatcccagtaagttactctagtgttagtggtgatgactaaagaaaaacgtaggatccaggatcctaaagccaacttttggggttcaaa

SEQ ID NO: 164 - DNA, 393 bp, Scaphoideus titanus reo-like virus 1
  isolate St_USA segment 5,1
tttaattgcaattctagtattgcaattctctagggaaagccaatcttatttttattcattctcaaattattaagatttatgatttaattcagatttaacaatttataaaaccccagtaaccaaattttgaaagcaagatgggctttccctagagaactgtaatacctttcatttgacactaaaatcaatttttttcgacaattgatggctaccagtgatgactcttaagcactcttgactgattcacacttgttagtatggatccaaacttcgtatggatttagtaaattgagcatgtcaagactacttttcacaggatttaacactaaatagacccccccctctcttaaacaggtgcttctccaattggctgggtgggttcatgtacaaaaa

SEQ ID NO: 165 - DNA, 400 bp, Hubei hepe-like virus 1
  strain WHCC116187 replicase and1
tagagggtatttacatcctgcgatcttgaactttacttaacagttatacaagtttggtcgtcggatgtacggttgttgactcgctgagaactctcttttgaaatctatccagacattcttagagatcgatctcgcctctcgacaatcacatactggatcctccggaagagattccgttagaggaactggtccaaccagattttcggatctttgctggtaatcctcttcgtttcgtggagttttatcgcatactaaattttctcagtttttctttattgttattttttattttatatttagattattacgcggtctattataataccttctacttttatcattctccttatttttctcttccttattcaccttatccttatcctgtttctttcgcttgggt

SEQ ID NO: 166 - DNA, 411 bp, Unknown
  Description of Unknown: Diatom colony associated virus-Like RNA Segment 3 genomic RNA,1 sequence
tgataagcatccagctaactatcgtatcgcgttagtgctagtaggttgcttatactcggagtgtgttctccgatccctttttagggaaacccggagtcaatatgacttcaaggtcgattttatcggcctattcagtgtggccgcaggaactctaaccgctacctccgcgaagcgattacgtgggaccgatgaggagcgaggacgagtcagcgttgcactagtacgaccagggagggttccgttgatctgagcttgtgctaatttcaccggatccccctgagcaaaatttcgattctcttcgttcttctgttctccctagtcgttactagtgtaacgctcgcctacggcctcactcactcagttttcatttatcgtctcggtttcccctccccctacccgatccgaccaaag

SEQ ID NO: 167 - DNA, 411 bp, Mossman virus
  complete genome.4
gcagcagtaaattgtttctaatgaactcagtttataatccatgctatataagagtccataggttgaacccctgcagacttacaacacccttttggctctgtcttagagaattatctacaatcagtattgcagtggattccttaatacttgggcattatatttcctccaacacatatcatggtctgtataatgcttatcagattgtaagacacctagggtatgagaactaaaaatggtactcagtaagagaatagattaaaactactagatattaagcctcatcagtatagacttaatagtgttttaacaattatgttaatttgatatttcggtcagtagtattaactaacctcatttgttagaatattacaaaaaacttaggatccaagaggagctccgtaagctccaata

SEQ ID NO: 168 - DNA, 412 bp, Unknown
  Description of Unknown: Uncultured virusisolate acc_7.3 hypothetical protein gene sequence
ggccaattgcctacttctatacattttatgtgtccccgtttcaattgaaaaattgaattgaactcaggaagactagggaccgtgcctgagttggatcctagatccatgtgcgtgaagcatacatagtaaatgtaagaaatataattaatattcttcttttttaaagattaaaaggtattttatattgtccgagcatttacgacctagtttttactaggaacgcccctttgacaacttggggcaaacccgcggcggtctgctattgcgacacgtcgaaatggtcactgttagaattgtataggtggcctgttaaccatatatggggtaactgtaaaaatagttatggccaaaatcgtcttaatagcctacagggaggcaacagggcgtgctaagtggtaatttatttacctaa

SEQ ID NO: 169 - DNA, 413 bp, Lonestar tick chuvirus 1
  isolate RTS21, complete genome.2
atttaaggggatccctggaaaacatatgtattattgaatgcggcccatatagcccttattgccgcaaactttccaggtagttatataacccattttactatgagcccagtaggaatataacctctcactgtgggcatattgtatgtttgtttgagctgtattaaaaaccatcttgggccatagagccattttgctagacagctgatccggagagaccagattccgttcatacagtgcgattgtgagttttcaccattgcgtttcttgctttgcttgtggagtttaatcaagtgtttcgtgaaatacttgacttctccaccgaagtagagacctcccgtgacatcctagtcgctatcgacctgctcgagagagcacacgaacttagtgaagacatacttgatctttacacaaca

SEQ ID NO: 170 - DNA, 414 bp, Thrips tabaci associated dimarhabdovirus 1
  isolate Tamono1 RNA1R
aggaagaagaattctcagtagtttgattgttttttagacctgcttggcataacgggacaagaaattgtgatgactccctatacatatcgctttgccaaattaatcttaagtcccggtacagagctggtctctgaatcggatcctatatatccttatatataaaggcctaatactgctaagtactgacatttactagtttgtaagaatcaacccagggggaaatgttggacggatacagattaagtgcaaggttcttgtacttaaggatgggaatctcagggttttgcattagaatcgtctccaataagggatggattacatcagggggttggagtgttttatcaattacttaaatttaagccggatgttaattaagatgtataaattgttctgaaaaaaactaacagacgtaat

SEQ ID NO: 171 - DNA, 429 bp, Ying Kou virus
  strain YK1714, complete genome.1
gaaaataaaaccaatacaatccacttttctcagttattccctgacccggaataaccccgaaaaacaaaaattccctggtaccctaacccggtatcacgaaatcgcttaccctgacccggtaagtccaaatccgctggctaacccccagttaactggtacgcgagtaattcccgtactttgctcccttcgcttaccacgaaggtaactgcccaactaacccttgggataaattctggttgacttaccctcaacttttctcgcacggctcacccccgtgttatctgttctcgctaaccccgagaaacttctcagaaccctcacccggttccaactgatccgctaaacccggaatcaattctcaggatcctaacccgatcctcttcttctacaggaccctcacccggccctctaatccacatcggattaaca

SEQ ID NO: 172 - DNA, 440 bp, Lunk virus NKS-1
  RNA, segment L, complete sequence.1R
cgcaccgaggatcctaggctattttgatgcgcatttttggtatctggaatggaagacattattggagagataaggcatctgtgtttaagttacatgagtcaagatgagcgtctgtccaggcaaaattaaacttcttaagtcagtcagagccgaagctgactttgatagaagggttgaagttgttatcaaggtgcatagagatagacagtgctgacaagaatggctgtgttcacaatcatgaagacaaatcagtggagaccatcttgattgaggctggtgtcatctgccccgggttacccctgattattccagatggttataaactgattgacaacaccttaatcttgttagaatgctttgtgaggagttccccggctgggtttgaggcaaaattcatagaggacactaataagctttcaagcatcaaagacgatttggca

SEQ ID NO: 173 - DNA, 464 bp, Beihai hermit crab virus 3
  strain BHJJX21702 putative glycoprotein,2
aatccttctccaacaatctccctccctctcctcaagagtatcctattattagggatcctcattcctcttgcatgctgtaaatagttctcagtatagtagtggacccatatattcttgccatagtattttccatgcttttcatacaatattagtatagcccaatgctcttgtccatgtctgcctgtatatttgcttatgtcgtgtgctgctttaaaaaacaatcaacaacctcgagtagacccttaaaaaaagtgtcctaaacaatttagttaaaaattagaattgatcctttaattcttgctagtcttcattacccagtgaattttcgattactcagtttttgttttttgtggatcggaagattaattctctaatttgatcggaacacagagtctatcaacctgtctccctgggaaaagacagccctggttgttggtggtttgggtcttgtggcgtgttggagg

SEQ ID NO: 174 - DNA, 468 bp, Elephantopus scaber closterovirus
  strain pt171-clo-1, complete2
acacgaagtgaccgttcggatttaattgctgcgatgagtattcgacgcgtgtggttaaaggttatagctgtaattacagtgttgtggtacggtaaggaaccttccattagtgaaggttacaatgctcttatgaacgatgactttaagtttatcgatacacacttctcaaacgtttcttatgctaagaaatgttatgatttggctaatttcgatttggactttctgcgcatcgttattattcctttgagtggtggtacggtaaacgaatcgcgtgccgatcgcactaacgtttcagagattgtcgaatcgcacatgagcgaccgagacagaatgaatatcttgttgcgtaataagcggatccagattccttcgctcttaccttgcgataactagagtctactcagtagtgcgtctactagtataacgtattaaacactttagtaaagagttttgtttaagttaaacaat

SEQ ID NO: 175 - DNA, 471 bp, Lake Sinai virus
  isolate LSV3/PNG_Ac-b putative capsid protein1
ccgttgcgcaccctctctaagattcacgtgtgttgcgccgatggatcccccaataacctcattgttgctaaggcccttagtgttctgaatctcaatccctccacacccattatcacagccttttgtcgacatatacttaatgtcgttcgttccaggttgctgaatccgcgaaatcgtaacagacttgctgctgccgttaagcgtgtcgcaccttggatggtttacatgccttttcgttacacgccttattatgctgagccatgtcctgccactcgcgccgcgtttgctgtgcgcacaggcatttcccctgccttgcagatcgagtacgagaagtacttgctttctctaacgtttgtaccatctaggtatgtcctgcttaagcgcgatgttgagctcgatggcctcagtactgtcctacttggcgacttccggtctgtcctttacgcgtagaatcaagaaatttactacgcc

SEQ ID NO: 176 - DNA, 473 bp, Fusariviridae sp.
  isolate H3_Rhizo_Litter_15_scaffold_562
tgggctctggggctggcaacatttctgcatctgcaaatcaagatcgtgcagatttggtcacaaaatgcacaaatttgatttctgccagtcttgaagctgcatcctctggtgacccttcattgttgaatgggatggaggaattagcctattttaacggcgcaactggtattgtgttgaaaatgtctaatttcctttttaaacttgtgtcagacccagttggtgaggtgtctgaaatgttcaatccaaacaatagggatccaactggtacactacgggacgtagcaaacgtgttttctatccttacaagcctggcttcaatcagtaatgattaagcattggcaaaaatcttatgatcctgaagagtctgttttacagcgaaaccgtcaaggtaggtcaacatgagtaccaaaaattcaaaagcccctagtgtggcatcgaatgagtcagctggtcaatcgttagttcgagagatc

SEQ ID NO: 177 - DNA, 475 bp, Fusarium langsethiae hypovirus 1
  isolate FlHV1/AH32, complete1
gggggtgtgaaaacctacacctattcacaatgttttcattatgaatcgtaggttcgcttcgttgcacagggttaaaatcccgcgctattttgtccgttacagacgcatagcagtgcaagcatacttagtcttaggagtatgcatcctggaagtttgaccggccctcatgggttagtcttttaaaatctcgggagagatctttgtggatcctagcgagcatcaatcgtggtaagacaattttaaaattggtgcgtgttaagacacacttgttagaaatttcattcagaaaccgttggcagttagcgaataactgtgatttgactgaaccccattatcagaacggcaagaaagatgaatctgtggagtagtgccctagaagattcaatcctctttctcgttaatggcttgtcacccaggccctggccgctaaaccagtttatatttcatcctagtttcttttaggattattagctca

SEQ ID NO: 178 - DNA, 483 bp, Wenzhou yanvirus-like virus 2
  strain beimix74779 RNA-dependent RNA1
ctggtgtaaactactttgctccccgggtagcttacggtcgagtcgaacggcattgaaaatgccttacgactcgatcagatgacggggagcgccccccccaggtgtttggtcgcacctggggggaatgacggtaattcacagaatagcgccgagctggaactggtgaattggtggacgtggatctaggtcttttgggttgacttaggtgtgagtgtaaagtgggtgaaaccgcagcccgaataagctcgcacgacggatccatgtatcaatactattactcgaacgcccaaaacacaggccgtgtaataggaacctgcgaaagcagtgcaattgggagaagcccaccgttgcatcaccaatcacctccaggcagttctgtggagggcccgatatgtcgacctcactcggcacgcgcgctcagcgtcaggcacgccacggtgcctgacgtttacacacacaacacacacacagcactttccttat

SEQ ID NO: 179 - DNA, 500 bp, Picornavirales sp.
  isolate H2_Rhizo_32_scaffold_97 hypothetical2
acgtacgcactctattaactaaaaggtatgcccgaagttcctaaatattcgggggtttactctttccacaaaaagagattaacatggttgacttgctccataatgcaagcgcttgagaacaagctatagttctgatggtaataccccttgaggaatccatatttctaggatccgttcaagtccgaagaattgcgcctcattgaattgagcataatatcgcgcgtgtcgtaggtgggccaccacgcgtatgatttaagtccactgctgattcaggtaatgaattaaaacttgggaatgaaacccaaacaaaaacagaaatcgactctggtttagtaacttttgaaatcaaggaagaagagataatttcggttagtcccgaaattgtaccaagcttcccggttcaaaatccttaccagaatcaaacagcctctcagatattatctaggtggcgagcaataggttcccaatcactgggtttaacgactcagtttgggacaaaa

SEQ ID NO: 180 - DNA, 504 bp, Diatom colony associated dsRNA virus 7
  genomic RNA, complete1
tgaatatgagcgagagcaccccataggtacccttctcatacaccaggtagtcctgggggtgacacttcgcctagctatgcaagagctttgaaagtgttcacctgagcacgcggcctcgtcagacaaggttagcgccgaaccccactagctaagttgatgctcaatcgtagtgtgtgtgttttctagcattcacgccgaaggttactgagctctgtaagattcacgtctgcggagtagtgattcaccgttaagtcgggatagcttcctgtttggaaacactcaggatcagggctaagaccccgtagaacagtagccgagtagtacaaactcaaagttagtcttgtcgagtctttcgcgcagtacaatcagggtaagaagccattggtaattgatggtggatcctatgaagttgtagctagctgagattctcatatatcttagttctagtaacaaaatcataggcgtgctgcacgaagcagaaggttttaagtgatattatcgctg

SEQ ID NO: 181 - DNA, 508 bp, Wenzhou picorna-like virus 51
  strain WZSBei69571 hypothetical2
tccatttggagcgtgggtgcgctccttaaatatacgcccttttaagtggctggcaccacagacggatcctctggattgtctaaacgccctttttcattcgcgatccgcttagttttcctgttcttagttttgcgtgaatggaatcgtattaggaaatgttgtgctagtgcgagatattcggtctgatctcgtaccttattttagacctgcaagtttatcagaaacacaaactactgctgatgttcagattcagcaaacttttgcctttgacgatagtgaaaagcaatttatacaaactgtccgggagggggaggatccttcccatgattgggggtcatattcggatgttgatttagctaattggcttcagcgtcccatattggccaccacaaagatttggaacgtaggtgagggttttcctgaaatttatttcaacccttggtctgcttttttggacagccctagtgtagctcagaaattgtcaaatttttatctccttagatgcaag

SEQ ID NO: 182 - DNA, 515 bp, Rhizoctonia solani mitovirus 25
  putative RNA-dependent RNA1
ctcctttacagagcatacctggctgaatcgtagtcacgacccaacctatggccttatatggctgtactcgggttcccgaaacgcgaagtaacgttcggtgtttgcaatagttctactattaataatactgaatgcgggtggagtctcaagtgagttagactaacggggtaaggtacctttacaggtaagaatccttattcctaggtctttctcatcctgagaatgtccacatatgcgtaagcataagagaattactctctggctgcagcccggggcctcattgaggatccggaaactgaagtttaaaccgctttactttgtacaacaacctattgcctcttatggtgatactaggatcagatataactagacggggttaccccctagcgacttgagtgtcgtcgtgtagtgagatgataaaacaaacagtgtttggttaccacttaaaactcgtgacctcatcgaaatctccctagtccctcccataggaaccgacaggcggatatttacctaaa

SEQ ID NO: 183 - DNA, 523 bp, Caledonia beadlet anemone dicistro-like virus 2
  isolate I38,1
cgatctatatttttcatacacaatttggcccacagttaagatggactctgtaacagacaaaatatcgaccgatttgcagcaatcaaatgaagcatatttcgacagaaaacatgaaccatgcggacgatatattcttaatagttatatcttacttgaacctttgagtacgttgattatggaacacacatggaactgattaggtcgatacgattttaacacaaactttttgcaagtataaagcaatgactagttttcaaaaagaaaaccggtatttacaccgtaagtaaaaaataattttttccagccttcctgaatatagtaaggaaaggtattggcgaaatggaaaattttattttatttaaacatagtttgttgaaaactattcaaaatttcattatgcgatttttaattgagacgtcttattaatagactaggtactaattaatctaacgcatagttttacaaggcagcaacaccgcatcaatggatcctaaccatagatgaaaagaagaaaaaacaaatc

SEQ ID NO: 184 - DNA, 528 bp, Wenzhou picorna-like virus 6
  strain WZSBei69574 hypothetical2
gtaaatcaaggcgtcgtgtatgcctattgtaaaagcacaccccgttttgccgatggggttccagagtaaagttgaacaggcatgtgtgtatatggttacatatggtgaaaatgttttatatattttgtattttcgttagaatgctttgcacataaataatatcctacagaaagggtacccgtatttacgggatgtgggattggatcccatatcaagatatgtacttctgcaggtttaatcgggcctgtagtcgcaaacaaatagattggtaattgtataaaagaattgtgttttgataataactgtaataaattagtttgtatatttggtaagagttcagcaattgttaacgctgaacctagtgctcacatttcatgtgggcgagaagaagacgctggccatcccggggccagcgcagtgcaactacgatccatagatgagatcgaggaagcacttggaattgtggagagcgatgctgacagcatatgcaccatattcgagcctcattccgggacaacggatgacaac

SEQ ID NO: 185 - DNA, 530 bp, Marmot picobirnavirus
  clone c293452_g2_i1_libraryA_2678 segment I1
tagatttacaaataaaatataggaggaagtgctatgaataacatgcattttaaagtagtttcagcgctactgaagttggcgcgacgtgttaagtacgttgtgtcgttattgctgacagccatctctgctgtaaaagagaaaattaattcatcaaaggaggttaatgatgatgaaaacaagtaacaataacaattcccagcggtcgggccgcactgcagtcaaatgtgatgtaagttttgaagagcttatagctgatttggatccaagtgacatccaatcccttgtgtctcagcctaagtgtcgcattctgtctcacgatcaactttcatcatatttgggtactttatgttctaatcattcaatggttgaaaatctcaaaattaagcaccaggaattttcttcaagaggatatcatggagtagtaactacagtcagttattacaagagatttaaatacagatatgtgtatgagcgcatatatacaattgaatatgttagtatttctgaaatggttatgggggtagaaaata

SEQ ID NO: 186 - DNA, 535 bp, Wenzhou picorna-like virus 51
  strain WZSBei69571 hypothetical1
tttatgcccccccttctttcgagaattcataccgtgtagatcgctaactaattttgtaagcaactaactttaggtcaatgactgtgcgacctattgtaagtatatctactgccaacttccatgagatggtttgttgtggtatgccgagctgatattacgttgtcagcttggatttagcggaaacgttacaccccttcctcctgcaacatggcgtcttgttgctttagtgtagtgtccgcgtcttagtattatgaatgacgcccttatatatattatatgttcgtaagactgaaattgtactcccgaagctatcacggagacgcatctatcacagtcggatttagatagatgtaggcaatagccccatgcaccacgggttgctatatacccctaaggcgtctaattcgtttaggcgtctcattgaacctggttaagaatctttaggtgcaacgggtgcgaaggcacccaatctgcccgtgtggatcccgtcctaacacgacgtttaggtcccgaaacggattctttgtccgtaagc

SEQ ID NO: 187 - DNA, 560 bp, Linepithema humile picorna-like virus 1
  putative RdRp and putative1
ggtaggattatagatggacggaacatcttaaaaattctgttatgtcctgattatgacagcactaagtgacaataaactaatcacccaaatttaaaactttgatttgatattcaagttgacgattataggcattcttaaaggaattgatttcgatttataaatggaaatatgttaatacatcaatataggactaagcgattgaaatgaatcaggaatttatttatggcgacagatcttaattacttgaatgacatatcctgtctcttatcatgtgttctcctatggatcccggtggagaacaagcacgacatgatttatattattgtatttcggtatgcacatagcaagtagtgcgtagccttcagtgatcagttagaaatttggtatatggtgactaattgtcaagtatattaaataacgttgttctgatcaatactgattgagcgtaaccttgttctattagcgctaggagtacaattttatagaagcttgcttcagagaagtcccggaagttatttatttaattaaatatttcatataggctaattctaacgatattg

SEQ ID NO: 188 - DNA, 562 bp, Yado-kari virus 4
  genes for RNA-dependent RNA polymerase,1
cgttaataaattcaaggatttattagctattttatttgatagttttgcttctgttcagaagtgtgccctgcatgcaatacatgcaaataggttaggcagtagaaatacagatcgccggggaccagcattcattctttacgaatcactgggttacagctactttgactagatcatatactgtatttatcattcgcgttggttggacctgtaatagcagggttccggtcttggaaatcaaaacgagggcactcgccaagatgcgttacgtcgtaacaacctgaaaaagtgggcttgacaacctggcctatcatacactggcaagtgatatgagaggtgatcaaatataccgagtagcatgaatatcgctacacgtagtcacaatttaaaaaaaaagcattctgacactgggaaagactagaaacaatcgtgggatccaacgatggtaaaatgacgcttgggaatcaacgtgcccaataccgaatcgatcacagttagtcaccaaagaaggtgcaattaaaagaacacatagttagtatcctgaacacgactcgtacaataactc

SEQ ID NO: 189 - DNA, 569 bp, Wendell virus
  isolate Antarctic4 polyprotein gene, complete cds.1
ggtggggatgcgcgcatcatacgtgatgtgtgcatccacccccccttttctcccctccccctccaactaccctttccccctcgttcggatgggttcttggttaacgtgaagtttggacgacgatacggcccttacacctcacgggctattggcacgctcgtgttgtattgcaagttgctcctaagtatgtacactggaaacgcacttggcacgtgcgcggaatgtcgtaccaatgttaggatctaagcagcgaaccttcgtagctagacatactactgcgtaggatgatgatgaccagttttctgtatctgattcaaggcactccacaagatcattgtacgccggatacggttctgacactgcgccctaacctggtgctgaaatattgcaagggcactggggcgttgttgttggttcccgccgctggtgatcgagtgggccccacatttgtgagtgcagttgttctgccgggtaaatgtgcacctacgtggatccgcagttgggaatctgcggttttaagtatgactgggtgatagccttgcggctggccaagttacgattgtagccag

SEQ ID NO: 190 - DNA, 572 bp, Spissistilus festinus virus 1
  complete genome.1
gtcacacacccacccgtgtgtgttcggcttgcggggaaacttactgcttgcaggaacgaaaaacaagagcagcacaaccgaacacacacgagtgtcccgtagggaccgagtcgggtgtgttgatgcaaagaagagagaagccgacagctctctactaggctgggggatagctctagcgggatgtatccgctttgggattttctgcccagtgcccaaaatcagggccgccaattcgacttaaaagggattggatggcgcctgtgccaagggtgctaccaagcacctggagtgccgatcgactacaacgggtcataggcatggccagctcaggctgggcccagcctgctagtaggggggatagtcacctgggggatccagggtatcgccaagtcaggtatccactgttctttgcttttgccaggtgctcagccgtttaactgagcaaattgctaggtcccagccgtatctggatttattatcttcgctgttgtttgacagtgctataaccctgctactctccttactctaccctctccttttgattcccattctggattcgactggagatagac

SEQ ID NO: 191 - DNA, 572 bp, Shahe tombus-like virus 1
  strain SHWC0209c12685 hypothetical1
attcaatggtatcggcggcattggcacagatggtttcgtctgtgctcgacgaggggcccaggatcctcctattcctggtggtgtgggttgttgtgcgtagggtgtggcgctggtttcggccgggccccactgctggcgcgcaactggtggccgagctggatgctggcccagactgggacaccgtgggtcacaccacgcgttaccagcgggagctggcgtatcggttcaaggcggagtttggcgagttgcgctataacaaggctaaccgcattgtcgcatcggcctgggtcctcaagaccatggccgctgatgacgtgcggtacgtggaccgtgttatgctcgagccattggcagtgcagttatgcctgctgcccacacgggctgcagtcctcgccgcggcgtttgcaaagacccatgaggtcaatgcgcgccgcgacgaggctgagctcgttaaatagggatgccctgctgaggtgcctggagtaaccacgtctgtcgaccgtcgtggtgaagcatgcttgcgtgtccgggcaagtgtcggcaagggtataaggtccggtgttgaccgtaca

SEQ ID NO: 192 - DNA, 580 bp, Partitiviridae sp.
  isolate H4_Rhizo_Litter_19_scaffold_21291
cgccacgtcgctcgtggattgctcgacagtggctggctcagtacgatgagtctcggcctcggatggtggcgcagcaaccttttctagggcgtgctctgcgcgccgcagcgattaagtcggcgcgttctgtggctacagtgcgtactggtgtctctactggtaaggatactttggtgacgacccttcgagccctgcattttggggtcgttaaagccgtcgagcgcgtcgactctgttccaggagcacagcttcgcaatccatcacctttcacccgaacgcgtaaattgcctctcccacagaccaaggtatgtactttcttgggaacatggccgtttaaagttggaagtcaaccagctatcgtgcgacgtacgacaaagtccctctttaagtggtggtctagtccggccggtgcaccgtaccgtgcgacatgtccggatccacgtaactattttcttgtcaacgggtcttggctgcgaatatgcatgtacttcgcgcgtttgcgacaccttctgatgcgaccgttactcgtgcggagctattacggtgtctctctttcgtacacacattgaacatccctttt

SEQ ID NO: 193 - DNA, 583 bp, Korle-bu Aedes virus
  16GH61 genes for hypothetical protein 1,1
gaaggttaaaggagacaagttatacgcgaatggagttcgaaagaacgccaccgtggatccccctccgtatgcaggcaaatcacttcaggcggctgcacttaagggccaggtagtgaccaacagtcggcccccattctgcgctacagaaaccatactggtcaagcgccccatttctaccagtaccaagagcaaagtgtgttctgaatctgccgatgagattaaatgcgatgccacgttgtactattatctcatcgacaagtttgcttacatgccacgcgacaaccgcatcatggggttgatgcataatgccctaacccgttacctaactgattatgactgttctaattattcgattggacagatttatcggttaaagattgacgctgttagggcagcattgtttccgcccagagaggagcaggaaacacgggtgttgttgcgtgattacgatcctaaggttttggagaagcacgcccagtggactggagagggcattttaggacgtaattcttggtggcaatcttccgaaaggaggatgcctaaggttaagaagtaggggtcgctagtttcaccctctatttgc

SEQ ID NO: 194 - DNA, 595 bp, Unknown
  Description of Unknown: Picornavirales N_OV_001 putative structural protein1 sequence
gtaacacgtcgaacctgttatggcttatcgtatgccctgctatggcgaaaatgctactatgcgatgggagactcctatgtctcaaactaggaaatccaatttcttttggattgccatttgtttgttcatttggccgctctagctccgagtgcgttgcacttgtaacttcgtgcgtaacgaagatagttgcttatttcgagaagcaacacttccgcctatatggctgaacctggattggatccctgttctggaaaaggaaagatcccctcccctctggttacccaagacactataccacgtagtgtcctatggcttaggggttgatgtgtgtccctcatggggatacccctttttaggggagacagcactgtcagtgggaccctgctttcaatcaaaaaagtgtagattgttagctgatacgtcacttactgaaaatacgaataataaaactaactcgtctgattcacatcaggcgttcgacaatgaccaatcggtaacctctactagcaacgttgtttctgctgatcataccactgacgtggtggtggttagtggacatggccacgctgatggaggtacaaccgatgattcctta

SEQ ID NO: 195 - DNA, 600 bp, Hubei myriapoda virus 2
  strain WGML147749 hypothetical protein 1,1
tggcgtttttggcagctatgctcggtggtgaagttttgaatatggggggtagtttaattggcgcaaaagtaaattatgattataattctatgttattaaatcaacaattggcaaatgctgaaaagtttcagcaatttaatgcaaatttaatgcaacagcaaggtttaccgtatttggctaacggtggccaaggatataatcctcaaatttctaatatgtacaatgccggaacgtctaatggatttaataatattataccattaatggctggagcgtctgccggaattttcggtggacgtggttcaaactttttcggatcccaaactagaagttcctccacacaaactggacagtcgacctccaattccttttcacagacaggacagtttacttccaattcttttgcgcaaacttatgcatcagcttatgaacagccttatacaggggcagatacggacttttacatctctccgccacccctaactggtactgctgtaaatactatggcagatgcagcaactgatgcgggtgccatgatggctgcgtagtcctgatttcatcttactacgtgataggataggcgctttgtatactgtaaag

SEQ ID NO: 196 - DNA, 600 bp, Hubei tombus-like virus 9
  strain WHBL63242 hypothetical protein 11
ggaccatccaggcaggtgtaggctagtaccctcacctgacctgtcgcgatgtttggctttgtgaggcttgtgggaggatcccttggcccatgcattgctgctgtcatcgtgaaaaatgttgtatgctcgcacctggcgtggaggaaacggcatttgacggatgctaaggaggatttgaaggtcctcaactcccatgccttattacaagtcccctttccttcaagcttcgagcccacgtctgtgacgagcagaggtgaggttggagtcaagaggagtcctattcaagctgttcgcagcaagaaccataaaactttcattgctcaatgggcaagagcggctaaggctcggttctcgtttgcacgacagtgtgagcggagccctgtaaatgtcgcggcccttcatcggtggtttgcatcggagtttaagaaaattggcatgaacttgctccaggtttcgtacgtgatcgatgaggttgttgaacttagtttggaaccaacgtatgagcgtatggtgtccgaaactaagaagcaattccgtcatcgggcacgtatggaatactacaacgagaaaaaatgccttgaaaagatccactaggaacgc

SEQ ID NO: 197 - DNA, 608 bp, Santeuil nodavirus
  RNA 1, complete genome.1
tattatcatactgacaatggtaatatgcgagagcgatagcaagcactagaaacgagttacgcaaccacagacagcaagcccggaaggcgcgcagagactgaacacctctgtgtggctgaaggctccccactaaccctggagagaagtggcagaaccacagcctagtactagccgcaaggcttaagaaactaggtgtagctgagtcctttcccttaaacaaggattggaccacttgtaggatccgtgtattcaaacgatctggcagcactatggctcggacaggtacaaccaataaacacaagcgttttgagaaaccggcgtgattgtaccgcagttttaaaggagcttcaaaccctcccagccgaaagatcaaacgaagtcgtagttgaactaacgtagtaggggagcggcgtttgaggatgttcacgggtcagtaacgtgaatagcttcattcgtgacgtgctcaaaccaccgtataggttcgccttagtcattagcagggatggctaggttcagctgcgcatgcacaaaccacaacaataaactaaactttattcgcgtatttgtgcattcccgttgcccacccacactcctaacaaatttcaagt

SEQ ID NO: 198 - DNA, 619 bp, Osta virus
  isolate OTU55 hypothetical protein gene, complete cds;1
caacaaccgacgctccccacgtccgggtcgagcgtcggttgcagggttttaaaccagttctagccggtaacggctagaatgtgattcatcacacttggggagacccgagtgtgttgttctcgtcatttctcaattggctctcggacatcaatgcaccgagttacccaactaacataaaacacgagagttgagataatgaagaactaaacaaaaagcacttcgaacactttaatacaaacctagggatatgacaatctttgcttgaggcttggttataccagccggacaacaaatgttggagtctcactacgcctacctgattatggtcggtggccaaaacgttagccctatgttgagagggtgcgggcgtgctaagtttcccgagaagggatcccaaatgccgaacgactggaacggccgcaatgtagtggggggacagtctattccgcgcaccccaagttagcgcggagtgctcaaattcagctccagggacagctcaacagacaaccagttagtatcgaaagtcgaccacagacgaaatcttattactaggtgttatacatccggatatacaaacagtctttttcaagactagggatttcagtgcataggacttgta

SEQ ID NO: 199 - DNA, 628 bp, Wenzhou picorna-like virus 3
  strain WZSBei69560 hypothetical1
cgtgtagcacgattattagttggatgcttatatggtatatgttgcgcaaacgctcatatgccatgtaggcactgattataagagtctacccagttttaactaaactctgcttctagttcctttagaagccacctaccgcgaggtagtttgtataatagtgtgtatatgtaagacctatttaataaaaattattcatatcttataaagaaaaaacttaggtctgtgatttgtataatatagtccatcagaaggatccctgaattactactagtcatgtagtaaggttgaaaatggaaatcctgcttgttgaatgcttagggtgcgattcactcactgtgtgttgtgatagtacttggataagtatttagtgacgcttgaatggtcactattgtcgcattcggaattgtgtgcgactgattcaagaggatatggtggaaaaagatcactggcgtaaggcaatccagtgaacactccaaagggaggagttagttcaagtttctccgtgtcaggctcaggaaagccgggtgtggacatccacctactgaaccggttttgtctatttccaataaaatagtcactcccaattcgcgcgttcctaacccgtccccgcaaaattaaagaattaatc

SEQ ID NO: 200 - DNA, 630 bp, Myrmica scabrinodis virus 2
  complete genome.1
gggaatccctatgcgcaattatttgcaactccgacgtggctgagtataaacgatcccgtatgtcctgaacatgacagcttagtcaataaaccgttcaccccaaactcatcaaatttacagtatttagatgtaactaaaatctttcactggattaacccaattaagaaagatgattagtataagttagttttaattattagtggaaatctatttcttttcccgtgtataagagagacctatttgcacgttaaatatttaaatggaatacatgatggtgtcatgttaaaaacactcttactactggcgtaagtattctcgcttttagtatcgtattaaagaaataccgtataaaagattgtgtatcgcgattgcgaaagctaagacaatgggtgtaacccaggtcgataaccattagcacgcggcatttgcagcaagcaaagcacttcccttttatattgcctcatactcgcgaggttcgactatgagtgtatggagcatgaaattgaattatctttcatgttctgtaaccttcgcttgggaaggacggatcctttctatttttattaatgacaactaaatcttttgttcagttgttatcaaagctatcaaagtttaaacaaataaattaaa

SEQ ID NO: 201 - DNA, 647 bp, Bat Paramyxovirus
  Eid_hel/GH-M74a/GHA/2009, complete genome.5
ttgtatgtaatcagttaaaggaatctattatttctcttctccattatctgattatatcctaagaaaaacttaggaattcagggtactgcccttaatgacttgcactaatatcaaaatttcaatatacgacgaatgtgattggcttgtattatcatcataactacctccagccgtatcactgacaaaagatttataagcactggatcacggagtcagagttcaaagcttactaacgtcaacctcattatatctagttggtgttacagggttacttcgagtcatatatgtaattgcacctgataatacctctctcatctagtacattacctcaacagtatgatctcggggatccaactacacctcgacaactcataacaatcaactaaatctgcctcacaattgaccattgccattctctcagtcataaaaaggatcatcccaactgattgattatttctttaaaccctaaacgtaaattattcaatcatgtaaaataaacataatactttcagatctacagtgatagagttcttaaatttattccaatataatcctattaattagcattgagagatctcccatgacatcacttttccagtcagttaaatctcagaaatccactaactgagctaccgtcgaagtcaagc

SEQ ID NO: 202 - DNA, 655 bp, Riboviria sp.
  isolate rfb198shi4 genomic sequence.2
gaggtgttattcaaggcgaatacaacaaaagcatcaacaactccaccaatgaatccaatcaaaagatcgctaagatgaacaatgacacctggacccttacaacagacaaaaacatccagggccagaaagacatccaaaagcatacagaggaccaattcacaaacaatggccttccatcttacatggcatatcaaaacaatgggggaaacgacaaattaccacatcagcaataccatctggggggaaacaactattatcaatctggaaactatggctcttcacagccatccatttcaaataattaccagcaatttaatcacgtgggagtcccttcaaaatttgaaaacaaaactgggaaacaaaaatttgttccgggtggaacactacaaccgaaagaacctactgccgttccgaatactatggtaaaaacaccattccctacttcaactggtactcaaaccagccgttcaggactcggatcccgtgttccttcaacttccaattttcaattttccaatatggacccaaaattttcttcaatgcttaataatcaggtttcaaaaagcaataaggccttcataccttccgataaagcaaaatttaaggatacctggactcagacaaaacaatcaagtactgccacttccatgatccc

SEQ ID NO: 203 - DNA, 660 bp, Changjiang tombus-like virus 21
  strain CJLX8746 hypothetical1
cctaaaggtaaacaaaaaccaacggcttgtcccgtaaggacgcaggaaactgcgagacaagaaaagaaaccacgagtgattaacacttgtaaacttaaggatgttcctttgtcggaactccaaattttcataaggaattatgaaaatgctaaggcgactgggattgagcctgatttaaaattcctttcaagacagaaagaaattttgacaaaacacaatcccaacagaaaagtgaagacattaggacccgacaagaatattgccaagttgttagctgataagagaactagatcagctgccttggattatgtagcgcaaacatcttcacttgacaccgatctttatggatcctatttagaagatgaggaatttccaacttatttggataactgtaaagatcgccagtatagacttaagaccgagccatgtcgatcgtcttatattgagaacttcaatgaaccttccacattggtaccacccaaagatttggttaatgaagttttcgaacagcctaaaataaaagattacactttaatagaagtggcttcatttaagtacgtccgagagaacgtcctaacagaagtatgttttaataacactattgagatcagaaatagtgttgaagattctaggttagatgttttgactaatactgatttg

SEQ ID NO: 204 - DNA, 667 bp, Unknown
  Description of Unknown: Armigeres iflavirus gene for polyprotein, complete cds, strain:1 sequence
ataacttttaaaattgcacgtaatgtgcactgcaattttaaaagttatttttctagtaacagtacaatgcacaatctaggcaattcatgtctcttatggcatgctttgtttggatgagttagtcctctgttgtactgggaaagctttagcatcccaaggaaatttagcgaaaccccaaacctgtctcctcgacacaaaattggaaaacaaacattatcgaaagataataaggtgattccgtattaatccaagagtagactccatcacaactcttgtaaataaaattgtgaattttatctatatttgtacccgcaatagcgctgacgcctataaattgaatttataagtatgcatttgaatttctatttcctattccatacgttttggataggacacacccctctaacaccacctcagacgtggcgcattgagtgtgtaacgaatagaaactattttgcatcttgtttaggaaatttgtagaaacgaaccgcgacagtatagtaaccttactgtataaagacaaggtttatcaagtatttcacacttgagatgtctgatgtaaattccagactatgtactatagtgatctaaattgatgttttacaaggtatgtttcttccgcttcaaaggatcctaaccttagaagaaatcgaaacaaaatgaaaat

SEQ ID NO: 205 - DNA, 667 bp, Bremia lactucae
  associated ssRNA 2, isolate DML-A_DN40638 coat1
gcgtccggttatttcacccacctcttatatctggccgaccaggatatctgaggtagcaatataatggccagaaggttgtgaaagcttatttctaacggcgcaatcgggaaagttaattcttagcccgtaagcctaggatatcaacctggacagaacgagccatagcataggcatggtgagcgagattccacagcaacatttagagaatgagagacaaaaaccccataaaaataaatataactctcttatctaggtgaccgtaaatgtattgcactttttgtttaaatcgcgggaattgcggcatatgccgtcgctcttgacagcgtcctccggagattgttcttactccgagtgcgttaatgtgtagtctcacttcggtgccactactgggcccacagacgagaagagatcactcttggtgcaaattggaagtgcgtacaactgtacgaacggtggccgaaacctagtgccacagcatcgagagtaaagatttcttgtggatccacgttgtcaatagagttgcgtaggtagtctgtgtgtgagcgcgactggttatgatcgaaagctatccattagcttccgaaactgttagttcaggattaggctgagtagcatcttgaaagaggtgtgcggggactcgggcagtggactttcataatcactactt

SEQ ID NO: 206 - DNA, 667 bp, Beihai weivirus-like virus 7
  strain BHZY60887 RNA-dependent RNA1
ttcacaccctgcattaatttgtgaacactttaaagggggggtcaggaggaaatgcctgactcgagatggcgtgtgggtcatgcaaacacccgttcccaggccgggccgggacccacgcaggtgagatgggacacctgtttgaatcgacgcgcataagttgttgtcgatcgggcgccagccttgttcttcttcactctgattccggagcttcagagtggcgagcctgtgcgatacgtaccggcgtatctgaggtgaggctgacaggggatccagaaagtagcgtcctggatggtttggccacctataaactccctgcccccgagtccaccgtccctgggcacggttaaaccgtgtcaacactggtcactgcgcggcgacgcgttgttggttggttagtggatctgagggaatggttgcggtccgctaccgggggcgttatcccgggcccctattttagggaaggactggtgcaccattttggaaagccagtcgacgctagtctccgtgagttgttcagtttttcgttgcttaaagtgacctaattaaggtgttcacagaccgttacttcagcttgactttgccgccaaacgtgcggccacatacatcccaatagggaacttttgtctgcacgagactgagcccagctcaacttgtccgttaaaccgag

SEQ ID NO: 207 - DNA, 674 bp, Neofusicoccum parvum ourmia-like virus 1
  isolate CREA-VE-26SY1,1
gcggtttttggccgccctcccggaatttgtggctttcctaaccgtgtgaaggtcatgtggtgttcgcgtgagtgtgtctagcggccctctaagggagcggtgggggttaaagcccgaccactagctgcacgtgtaaccatatgacatgtaacatccagccaccttccggcggtgaactggcgcgtctgagaacgctccggattctccggcccccagagggtccatcgtaaacggtgcggtaactcaaagtacgaaattgaggggtctcagccccataaaacaaaggaaatgagttataaagagggtagcgtgcggcaatcgcgcgtccataccgctaaaccggatgggttctcggcagggagtgtgtgcgacagtaacgagtagtgtcgactgcgcgggatttggccgctgtgaaatgcggtctgtaaaaagggatgttggggccttaccggtgattgagcttagtaactcttcccagtaccaggactccgtgactgtgcctcgcgcgcgacggagcttacgcaagtgtgtcttcggatcctgggaccggttcggttgacatggtggttcccattccctatcctattctcgctggcgaaacaccgcgtctccggagacgctgatgtgtataaaggcgaattgaaatttggaccaaaacaaaagaaaacgatcga

SEQ ID NO: 208 - DNA, 679 bp, Changjiang tombus-like virus 2
  strain CJLX30692 hypothetical1
gcgccaactgttcgtcgtattatccaacgtcatggattccacaagctccgcagttcaagcagcttttgtggcctgcaccatcgggaaaatcggtttaactctgtataaaaaatggatggcaccccggtgggctgctgaccgctatctggctaaagctgatgctacaacccgtgtgatcatggaagaggttgagaatggacatgactttgaagtccatcaactcacagtcgacatatcctctcagaccatggacactccggaaaatagcaccaccaaacgtcgggttcggtctaaagccccctttcgtgcttaccttgtgaggtctggcaaggctaaatttggtctcatgaagcgaacacccgccaacgtcatgtgcgttcgcaaatacttgtacgacctatgtgttgtgcatggggtgatagcacgacatatttgtgagaacgtagacattgcttcagagcttgtcttcattcccaccgctcatgagttagaaacacttgctatgcagtctagccgatatggaaaacgtcagcatacagttaagaacatcctctctgaggatgcctctgactgttgatggggccctgctaagttggagggggtagacactgatccaagcgactaccccggactcactccaacctacgctgggatcccaaaacgacgaaagtgtttgtat

SEQ ID NO: 209 - DNA, 681 bp, Hubei tombus-like virus 36
  strain WGML125257 hypothetical protein 11
cagttctcaacacagaacaacgggtcatttgtcgaatgatgggatgcgacagttcccattttcccttgacactggaaatattatttcgttagataattactcatgtgtcagttgccttgccggagatccgcttagcaacactttacatcttcccctgtgccattttctggatggcctgcaaagccttacggggccgagctcgagtttcgtttatgcgttacgacaagtttacgattcaggttggaataccgccgtgatttcacgtatgccaagtgcgggtgtgcgtgccctctaagttagaggggttaagcagggatagggatgtttagtgtgtgttttgggatgtgaaggaagaaacagctgatatgtggggagctaaggagcgttttagttttattccagcgggtggatgagaagttgggagagaaatcgaccgcactggggcctgaacttgccctataccaacctcaccaaacccccctggggaaatgtccacggtgccaccttacggtggttccactcttttcatcgtgagtgcaacgacggtacttccatttaatattgccgagcggatccatgaaaccgctgagcgattgcgagtgacaaattgcgactgtgcctaacggcattggcgcgacggttaaaattgcacaacaataaagtaatccaggcctgaggcca

SEQ ID NO: 210 - DNA, 687 bp, Lasius niger virus 1
  isolate Cambridge-Lni, complete genome.2
aaagttgtggtcttttgctccacatcacgtctaagcgtgagcaatcaacgtgattaaataaatgaatgcatagcgttttgtgtatacgtttacggactgtaaccctgaatacacaccttaataaaggcgaaaccctaatcgtctctattattgtagtcctccttgtcacgggacaaatgcagggcgttcacgcatcaaacctacgagcgttcaagagccttactccaatattgtttgaggttaaggcagccaccccatagaggcttaattcggcatttagagtccaaggttggagcacatgaatcaagtaatgtgtaattcgaagatggcgattaagtttaatcattctgaagtcctagcaagatggaagaaagatgtggatccgtgtggccgttagctttgatgtaatgtgaattgctgtccacccgtgtgggtcggctggacagaaaggggtacgacttggtccgcgcactctacggagggcataccctgtacccattctggcgatggatacaccgtctcaaacttttaaatacaacttatgtgctattatttttgctgctttatacgctgccctcaacctgctattttatatgctacaatattgatactgctatatttgctaacaattatattgctatatttcttataagttgaaaagtaagagacgctatatcctgagataaa

SEQ ID NO: 211 - DNA, 724 bp, Rhizoctonia solani mitovirus 31
  putative RNA-dependent RNA1
gggacctgatggtcctcgacggcggagaagagctttcgccctctcgccttcaacggttagttccgtgtaactcaacattacagttgaggtgcattgcgctgccttagaggggagacccccaaagccttaagtggtggataagtgttggacattatttgtttaacggctgtccgccgtaggttattaactctgtgtttaaaccttcgaagtatggaggatctgaagaacggtaatttattactgtaactttgggttagtacatacgaggaggtacatatgatttatgtccctacaatactaacgtatagcttactaaagctggctgcggcccaactgctgtaatggcggttggaaaccgaaggttagtgttcttaaattactttacaaacctatatatggacagtataccaggcactgattagttcataatcaggaaggagtaccggaaccctgtgcgaagaaaacctcgaaagaggcatgttttcacctgaaatcctcatagcagtaccttagacagtactcactagatggataggcagtcactggaaaccatgcatggtgctaacgggaaatgaccaaaaagtctagttatccgagagctacatatatagtaacccgagctgagtaacactcagaaggagggtagtgaaccatattggattggtccgtaacgttagaagtgatactaacaggatccctttgtggagctccagatattaatact

SEQ ID NO: 212 - DNA, 741 bp, Hubei picorna-like virus 6
  strain WHBL73048 hypothetical protein 11
atgcactagtgcataactaagtgaagtttcagtgagcttttgtggattacccgctattagctcatatagctattagactgtgattttcgaaagcgaacgaaatggatctaagttttgtgttattgtgttgcgagtttttgcccctcctcgggttaccaggaaaacaagaaaaagctacgaaggccggctaagtgccttcaatttcgttttcgttttagggcgttgtctgaagtaggttcccaatctatttcagcctagtttatggtgcaaaagttattgctgagtgattaggataaatgagcctaaacgttatccgccttgacaaccgtttggtttatgcggaaatcatggatccccgtgggtgaagtgatattccggtaattgttaacggctcaagccagggtgcggtatgcgagtcagatccgaaatccataaatattcttccggtccaatattccgatacataatgtagagcaagaggccaaaggttaattatgaatgaatgatcgtgattcataatgtccccccttttcgttcccgtaattatgtattagctactggcccatcacaggatgatgggacactagtgaaagcgtgctcttctgggaggttgagcggcgctaggcgggcgacctgaacgcatatatggcaagtttgttctaatcacaaagataacaataagcgtgctgcataattaagctagttttgggagtcagcgggctactgaagtccgcacaccca

SEQ ID NO: 213 - DNA, 743 bp, Plasmopara viticola lesion associated mitovirus 32
  isolate1
gggcgcgagcccacagtttcactaaataaccttgtgaaatggttatctttgtgacctgccttaattggcggcgcgcactggtaatttccctataggaaaattcctttaacgtggatttagtttcgtagttgttggtcataaggccgcctttcgcgagggcagcagttgacttgggtttgcaccccatttcactgtggtataaagccaacagttactttctatataaagcgttattgaagggtagttatcctgcctttctttttagtcggaaacagcgaaagatcaccgatctcgggtttgaaatagaacaccgatcacggaattgagctgcccggtagtaatactggggggtccgaggaaaagagggtaaggctaatttagccctatctgtacgatcagaaccttgaataaggcggctgcagcccgtagtgatacggaaactgaagtctttactcgatacacaataaagaactaaagcaacacaaacatataatttaaataaaatattgttcgcgactgccactaggtctttaaagtcactgtcaaagtgaagtgccgggatccaagtaaaattgggtcgcccgttgctgggtctcttattgagattcattcccgcaacgggtattaagatcgacagaggtcgggttaaggtaacgttatccttcctagcgacgtgtcataatcttttcaagtcaaatggtttaccttttttggttaaatcattgaaagcttgatctgttatt

SEQ ID NO: 214 - DNA, 748 bp, Fer-de-lance virus
  complete genome.1
gcaggttggcgagatatccatggcagtttcggatctaggtgtcattgttagaaaagtcataatgggcaattccgagagggacgaaaacttaacagcactaatgatgaagatgcaaaaacagcttgcaatccaggagggaaagctggaaactctgcaatccactgttgggaaaatctatgctaaagttgacctgatcaaggatcatgtctcgaagtacatgatattaacaagagaaggaggtaaagacagtcaagaacatgaacctaggagattgatacagtcttacacaggcccagggaaacccgaagccgtgatcaatgagcatggccaaatcaggctcaaaggaacgaccaggagtggcaccagttggaacacgaccccacatgatttggtggatcccacaagactgacgatgtccagagatgaatcaaatgctacaaggtttatacccaagcttgatgatgcttctagggcaactctcctcagcctcctaaccatgtccggcctggacaatgacactcaaagcacacttgaaggaataattatgagtgccacaagagtagatcagctaattgaggttcatgagatactcttggaaccataacaaccccatatatgatagacccagtatatctgtgcaatgtcgactctccaacctgacatctgagccacaccgccatagaacaaattccatccagtcatcaccttattaagaaaaacctaggaacaaagttccactggttccaga

SEQ ID NO: 215 - DNA, 752 bp, Picornavirales sp.
  isolate war204pic2 genomic sequence.1
attggatatcctgacggatccagtccaaattttctttaatagaataacaaccatgagaatgcatgggcgcatactgttggatatatctagtttcgtaagatatatggtatttacagttttaacctaattgacgccatttttagataaatggtaactagtttcaaaaccctcgagattcgaaagaactcacccttccgtttgcgaaggcaaagaagttccgaaaatcccgtaacccccccaagatcggggatgaagggagaaggaaatctaatccttgtaattattattattttaagcgtctttctatatgtagttgtagagagagagtagagtagagagagagagaagaagagtaccaacagagaagtactattaacgaaagactcttaatttaatataatgaaaaggtcattacgatgaattccccagaagtgaatctaacatcaaaagttcatttcgaaggttttgaaactagttaccatttatctaaaaatggcgtcaattaggttaaaactgtaaataccatatatcttacgaaactagatatatccaacagtatgcgcccatgcattctcatggttgttattctattaaagaaaatttggactggatccgtcaggatatccaatactatttattagttaacatgttagtgacaggccttgtagccctaactatcgcatctgagtaaacagattagacaaatccaacgaatttattaggctttatcgccaatcttctacgtgtaacca

SEQ ID NO: 216 - DNA, 760 bp, Crab spider picornavirus
  strain J1 polyprotein gene, partial cds.1
ggctcgtgaggctggttactagctgagacgctagcaagcacacggcacagaagggatccctcgtcgtcacaatatcaacttgaatttctgtttggttgataaacccattccattggtcagttaaaatcgttggtcataactctcgcggtcaagatctctgggatagaaaatccatcatttataaccgccctcacttgtcggatatgtctcattcttttgattgaatcctcttccttgtaaactgacctagtcctttacattgcggaccgattcctcaaatttatgactcagatgtgaaacccccttttctcaaaaaccccacttttctttgacttggcatgaatttggattattctgactatcgattttaggtttaaggcaattttggtaaatgagtgttgtggcttgtaaaccgcagctcatatgtttgacagaaagatcttgagaaacatgatactatttagtaggacctccgaacaatagtccctcatgactactcttgagatgaagttgtttattatatcttgttatattgatttagttcggtatactgagagcattcatctaacccacatcagtcccctaagttttcggacgacaaggctgattggagtatttgtctaaggtaataaatgatggattttctatcccagagatcttgaccgcgagagttatgaccaacgattttaactgaccaatggaatgggtttatcaaccaaacagaaattcaagttgatattgtgacgacgagggatccctt

SEQ ID NO: 217 - DNA, 762 bp, Soybean dwarf virus
  isolate IA-2016, complete genome.1
tagacgtaggcaagtttaatcttgcaccaatatagaagtagttagcgctttccattgttacttataggagccaaatttggtgagtcccgatcgatggatcctgggaaacaggttcggtgaacaaaaagccggtaatctcggggagatgtcagctcccgtcgtatcactttcggttgcatatccaaagaataaccctatatttgacaactaaaaaatagatagtttccgcctctcttgtaaaccacatacaagatgcgagcttgtggagagtaccttcccttgaataaggagggttgaaagtttctggttcccaaaccattgatcaaaattggctctgcttctggtgattacactgccgctgaatcaacagcgtaaacaaattcctattggccgctccgtgaaaagagagtggctaatacgcccctttgatggcgttaaatgaaagcgtaggtcgtacgacaccccctgtcaaggacagccaaccttgcgaagtcgggagaatacccgatagactgtggtctagtattaaaatgactcgagggctcttcctcgttaaaaagggggcgacggcaggcaactgctgtcattaggcgaaagcctctttgttgttaaggtggccatcgggtccacctgccccgtaaagttgacacctttacagaagtgttcttgctagtaagagttatttccttgtgaagtaatacaagaacctcctcccggcatcttcgtatcgtgtttgaggaatctctagtgttattgttagtt

SEQ ID NO: 218 - DNA, 773 bp, Mumps virus
  complete genome.1
acgggaatggagcctcagctgggtccaaggagaggtccgggtctttgagtggtgcaaccctatatgctcacctatcactgccgcagcaagattccactcctgcaaatgtgggaattgccccgcaaagtgcgatcagtgcgaacgagattatggacctccttagggggatggatgctcgcctgcaacatcttgaacaaaaggtggacaaggtgcttgcacagggcagcatggtgacccaaataaagaatgaattatcaacagtaaagacaacattagcaacaattgaagggatgatggcaacagtaaagatcatggatcctggaaatccgacaggggtcccagttgatgagcttagaagaagttttagtgatcacgtgacaattgttagtggaccaggagatgtgtcgttcagctccagtgaaaaacccacactgtatttggatgagctggcgaggcccgtctccaagcctcgtcctgcaaagcagacaaaatcccaaccagtaaaggatttagcaggacagaaagtgatgattaccaaaatgatcactgattgtgtggctaatcctcaaatgaagcaggcgttcgagcaacgattggcaaaggccagcaccgaggatgctctgaacgatatcaagagagacatcatacgaagcgccatatgaattcaccaggagcaccagactcaaggaaaaatctatgaactgagagccacaatgattccctattaaataaaaaataagcacgaacacaagtcaaatccaaccatagcagaa

SEQ ID NO: 219 - DNA, 774 bp, Wenzhou weivirus-like virus 1
  strain beimix75799 RNA-dependent RNA1
agaacccctcgcgggtcttgcatgcaattaacgactcctctaattagaaggggtgtcacggggaagacaacgccccgtggcgagaaacgcacgactacatttctttgaccggtttacctgccgccgcccggtagtcgcacctgtagaaggacccaggtgttagcagagtgcgccgaagcgtgcacaatgctggtgcgtgccttattcttttgccgagtccgcccacggatcggtggaagcctggtggaggggacgggaccctcctgaggtgaaggcctgtggaaggggggggataggcacccctaaggattggcctcctgtacttccatgctacgagtcggcccggtccggggcttcattgtcaaccgtggcccacacgctggtaacggcggtgggttgctagccgaccttgcaaatggctacgaacccgaggtgtggcggatccacatcggcctattgctatttcgtgcgaattactgcccctgaggggaggtgacaaggctagagccagccgttggtagcttgccctctcaggcccagtaaggaatgcccgttgggacgcacgtaacagtagggtcgcctttgtacatagtgggacatgcatgccacctgatcaacgctggaagtacttccggtcccagtagttgtttcttgtccgggttacctacggtgcaaatcgtggatgccccgtatgagaaatgaccattgggaccgaaagcgcgaaaccaacgttagcaggccaaagggaatccccttgagcgaaattagcttgca

SEQ ID NO: 220 - DNA, 779 bp, Rhizophagus diaphanum mitovirus 2
  RNA-dependent RNA polymerase1
ggggggggtcccccgcgcaagcggtgtgggctcttcattgagcggtagctaccaactactctccacatgatggaaggaccttggttattccagatttactctggaccctggcttggttaagactgcaaacgccactaggcagttctataaaacggacatcagtgccccctatgctgttacttggtaaggaagaagaacccttcttcatcccgtcagcatctccatggctggagtataacaaaacgggtgagtgcacgacctgggtaaggacccagtgaggctccgaaagtaaggcttcgttgattgtagcgtaggtaacggtctatcactagacaagtgccccttaactctggaatctcgctaatcagagatcaacgaaataaccaaagataatcaggaacaccggacttatacctctgtatgtcgggggggagagactccccacctagtacttggacgacttcctcggaaggagtctaaggaacggtcaagggaatctcctacggtagagctggccaagtcagtttaagattatagtgatatagtcttcagagcaagtagatccttcccttcagaaaggaaggactctcctgatgatcctcgtgagaggagtcacctcacttcagacctcgtacgtgtggtacggaaggatccccagacggggagaaatctgtatctgtcggcgacaactcccaccatgccctcttgggggggattgaaaacccttttaacccttgagagtaaggaagcccttctctgaaaccccacttaacttcgtc

SEQ ID NO: 221 - DNA, 781 bp, Rhizophagus diaphanum mitovirus 4
  RNA-dependent RNA polymerase1
cttcgccaacaattacggtggcttccgatgatctgcgccagtaaggtagacgtaccccagaggatccttttaaaggcagtcatcttctccttgcacttgcagtgctggccacattgtaatggaacgtaaggaataccttaatatactactggccatagttatattccatcctgagggtaacctcttgtatatccagggtgccgccttttactaaaatatatacttcaaaactgttacctgtccgctaaaacctattggtaatctcaactacacataaagcaaggtttacgccgtctagttctattgtaccactgagaggctatctgtaacgggccccctgccgccagaggtagtacgatatgggttaaaggacccaatgttccccatcaagatataccatcgtcactggtagttcatcacactagctcacctagctctcccgaagattggtcgcttctgggtcttggggtgcctgagataggtacaggcataaatacaccacttacccgtgcagggtaccataccaaaactccccttaaatagcttccacatggttactgtccctaaactctctgagaaggaagtcgttaccagagggcatacgtgctcagtaataacaatggcgaccgaggagggtggtttactaactatagtacgtatttggagatactacgtgtgcgagatctccggccgacctaccccatggtagattgtgcccccctgctctgcagacgaaacacatgggacactgtataggaaacaaaacatatgcgaaattgtt

SEQ ID NO: 222 - DNA, 807 bp, Cryphonectria nitschkei chrysovirus 1
  RepAsoc gene for replicase1
tgataaaaaacaaaaaaccgctttttgccattatcactcaatcaactactagatatgaataaattagacgattttagcgatgaaggcggtgcccccgcgctaccggggggatggcgcagaacggaggtaggcaagactataactggctacctacgtgataacaatttaggcccatggaataagttaactcacggacaaactaaccaggtcagacggatgttctcagcccttactgttagcagtttagaaagcgtgtcatcgcctggcccaccaaggaggcggttaggatacattgtactgccgcctggtcacggtaaaagctatatactgaagataccaccgcgacctgtccaattggttgaagctgatcaggtgatggattaccacctggatcccaccctggcacggttgcgtaagaacgcaaaagctagtgggtattggcaagaatacgatactaactatgctcagaggttggattcacgattgccgttcggcgattgggtaatcatgctacctagcgatgagttgggagtaacgatggggtggagtagacttgggacttatatattggctctggacgcgtgggcaaataatctcaagggacgtaaaggctcgatatctgagtatagtactgtatatagtagggctcagctgattgaaggtgttaaatgtttcggtacaaacgcagaactacaggcagctgtattaagggatgttaacaagttcctgaccgcctgaagtacctgatgagtctcccccaggggaacgaaacgctgtcgcgtcgtaccaggggcaacgcaacgaaca

SEQ ID NO: 223 - DNA, 808 bp, Human rubulavirus 2
  complete genome.1
gctcttaaagggacttgatcttcgccttcagactgtagaagggaaagtagataaaattcttgcaacttctgcaactataatcaatcttaaaaatgaaatgactagtctcaaggcgagtgttgcaactatggaaggtatgataacaacaattaaaatcatggatcccagtacaccaactaatgtccctgtagaggagatcagaaagagtttacacaatgttccagtagtaattgccggtccaactagtggaggcttcacagccgaacaggtgatattgatttcaatggatgaactagctagacctacactctcatcaacaaaaaggatcacacgaaagcctgaatccaagaaagatttaacaggcataaaactaactttgatgcagcttgcaaatgactgcatctcgcgtccagataccaagactgagttcgtgactaagattcaggcagcaaccacagaatcacagcttaacgaaattaaacggtcaataatacgctctgcaatataaaatgaggtgcagtcacacaagagacactcaacatgcatccaatcaagatccagactccatccatccaaaaacacgcccacaattgtcaacaccaagaaacaaccacagccgaaccatgctcaaccaaaagacccaaacaacacctcacatcaatagaaggctggacatgataaatttaataaaaaaagaaaagaagttaagtaaaatttaaaggacacaatagagaaaatctaggtccgaaagcttgcctctcagacagatcccaaaatcatagtccaaaccccaaacacagcagcagac

SEQ ID NO: 224 - DNA, 812 bp, Dicistroviridae sp.
  isolate rbu035shi1 genomic sequence.1
actggcctcccttattattaggagacttcaaaatgcgtacggggttaaacccgtacgcaattttgaagtctcctaataataagggaggccagtccgtctaggtagactcgtcatatatacatttattgttacggcaattaatttatatatttgaagaggcctattccggctgcccatagtgttattgtatccctctgatagattcaccgtttctaacactccaaaccaatgcaaaactgactttgtcgacattgatcgttaagagagaaacaaagatgttcaaggtactagctatggcgtcttaggagggcgtaaaactcccgcagtgacaggcgtatctgtctaccccttgactgtaatataagttgtatgaatgagtgcgtgctcccgcaagtaataatagtgagcaaaattaattttaagttagttttaagtctttcatatatatttatttcattggcatgtcacaaatcgtgcagtttattagtacctatacgaatcactgacttatgaaaatattatttcgatatctctaagatatagttttgcccagtgggagtctatatgatttcctgcgtgcttcggctgaggcaaaatttaagatttaatatgagtagtggaatatgtgaggatcatgtgggaaaatttaccggtgctggatctttcatttttattataggtccttccgcacggacaggttaaccgaatttggcacttcggatccctggataataattgccccctttccacctcagcaaagtttttgggttaataaagcttggatttgaggatcaaaatatttttctctcatc

SEQ ID NO: 225 - DNA, 814 bp, Picornavirales sp.
  isolate H4_Rhizo_43_scaffold_235 hypothetical1R
cattgctacagcccttagagaatttactttacatggtaaaaacacgtataaatactggtattctgaattaatcaaactaaaagaagattattacgaaggatatgaatttgaatgtcttgttcaccgtgattaccacatggctctcaccgaaactcttggtggagatcatgtttggtacatgtaaagtccaaaactaaaactgtaaatatgtaaatacttttaaaatacgcccgtaatggcgttaaactattttggaaacattatatttaatggatccatgccccaaaggcaaatttgatgtgtgatcttgctcccttataggctcatcattataatctagtagtgctgcatcaaataatctcaggactttttagtcactacgcccaaactgagagttggcaatcccaatgaacaaaagttagatgaaccctgatttagtgttaattgaaactaaattgggttaaataaaccaattgctaacactaactcaaatcaaactaccactagtgttactagtggaatcctcaatattggagattcaacccccactcccgtccaaggtacacccgaggacgctcacactgaagctgctgttaatcaagtttttcagcatgctactaccaaattcatcgatgataatgataccgttaacagagatgaatccaccgtcgaacatatcaactctagttggttatcactcaacgacacacaatccactgagcaaactattattgattttctttcgaaacctatcattcttaattcaggtactttttccatttctgatacttattcttttcttaactactatact

SEQ ID NO: 226 - DNA, 827 bp, Unknown
  Description of Unknown: Fesavirus 1 polyprotein gene, complete cds.1R sequence
gttttcatcaaagttgaagctcctgaaattgacagaagtgatagaagatttcaggagcttcaactttgatgaaaacattaatacgccttttgagtgcttcaggatccgtcatacgagactggagctccgcttgttgagcatcgatgtcgaaatttgaagttagaacgacgaatggggaagagaaatacacattgcctttgcctgaacactcagcaatattgagtggatagggagactcgtctgtcatttggataagattgaatatttcattatttcgatactctggatctttcatttgaaaaacgtcgttacacactgcgaatctctgataggcgtactggtcatggtatggggtgtttgacatgactgcgtatatatcccgggatttgtcaaagtcaggctctccaaggacagcacacaagtcatgtgccaattgtggaaccatgactgtcttcccaatacctgggacgccataaatatagattgtgtaaggtttcattttaccctcacagccgacgaatgatgctaagtttccagatatgattttttcgagcttacgaacccgatcctggattggtttaacttggtcagttggaatttcgtgcttctcggactttcgcacaaactgtcttccctgagacagcagggacaaaacctggagacgagaaactcgtgatttagttagttcagccaatacattccaggatcagcaggctcaggctgttgattggtggggtttggtgcgccttctccgccttgatatcattcaaacattctcgctatctgatgctatatcgaaaattggagttaaccagcaggaggaggaa

SEQ ID NO: 227 - DNA, 834 bp, Marnaviridae sp.
  isolate brb141urn1 genomic sequence.1
tcaagcacgtaaacgtgacataggaaaatctgtttttgagcagaatttttcctatatcacgtttacgtgcttgacaatgtcaagtgtaatccgattgaggtgcaaggcctcatctgccgcgttagcggcgcgctaggaccgaaaaagcaaaccctatgtattctgctatttcgattcgtatacattgggcgttgtgatcgacccaaagcgcgctgcttacgcggcatagggcggtgtcgcaagacaccgcccgttgggggtgtaatccccccctttggagggttgaaccctccaccttagtcccagtaggttcccactgagcaaacccagcaatggatcccgtggaccattcggccagaccaacactctccggagttagtaattcatccgtttggacacgctacacatcgtcgactgctaatcacttcgtgcgtgctattgtgggccgtccgcgtccactctaagactttgtgctatatatttcaggggggggcccctgcctcccccactgcatatacattgacggaacccaccgtcgttaaacaagtggagaaaaacagcgagaactgaaactcgcagaaaccattgtgtcgctaaggctgccagaataggcttgcctggtgcagaaaggaacccataacctccgacctctccgttccgataaaggacgacgtcgaaggcgaaactgtaagttgatacttttgtgtatttgccaaacgagctcgtcgtaagaccctacgctcgtgtaacatttgcacaattgagatactgattggaccctctatgccctgatagctagatcgatacatttactcatcacagtaaaaggctgag

SEQ ID NO: 228 - DNA, 855 bp, Perth bee virus 4
  isolate WA2-63 nonstructural polyprotein gene,1
ggtgcaagccctccctcccacttggtggttggaggtgcacgttcaattccaaggcgtcctgcgcagtcgtcatgctgtgcggtgtacgtggtaccggctagtagatccgagagtgtacctggtgcgcagcccgttcctgatactcactagtggcaacccctgtatgaatgagccgtcttcagggttagttagtggcttaccgaatctatttctacctttcaacgcaccgacttaggtgtatacaatcaggacgttagtggtccttctgtaagtagtggcacaacttcttttgtggcagaccccgtggctgccatccagccggtcggccggtccgaccaggttgaagagttgtttgccccgaattccgttagttctattagtgactatttagctaagccgtatcaagtatttcaaggccctttcactgttgtggatccaattggtgccattttgtattccgccgacacttttacttattacactaacttgttaaaaataaacaagcttagaggtttctatggtctgcgggcaacgctgtgcgttcgccttgatctcaatggcactccttatcacgctggtcgtttgaggttgtgttattatccttgttattctgagaatccaaggaaggggtctgcccatgttcaaaatgttatttctatttctcagttgcctggtgttgacatcgaggcaaacgagacttctgttttacttcgcatcccttatgttgctactactcacttcattgaacttactgctggccctgttgattggggtcgtgtttacgtttctgttatttctcctttgcgtacggggcctgacaaccaacagcagatcaattatagggtctggacttgg

SEQ ID NO: 229 - DNA, 859 bp, Lothians earthworm bunya/orthobunya-like virus 1
  isolate L381R
gtttgaaataagctgtatgtgtgattgagatattgctattccgtcacatagaatttctgtgaatccactcttatctgatgtgaatgatgattcaaccactaatccactttcacatttgaaacaaccgtggcatgctgttagtttgaaatttgttattgctgccttttcaattagtgtttcaggttttttacctttgatagtgaaaatgaagtttagatcattcattacttctccaactttgtaaattttgtcagcaacatgtctgagattgtgctcagaatgcaaatttctaatcaatttgaagttatttttgcagcaagatttgaaagtgaaaaatcgatttcttgaaaagaaacaattatgtttgtaatcagcatcatcagaatcacaatcaaaatatggagtcattccgtcaacatgttgcagtgtgccaaatctatttgaaaattcagacctatcattaattgggccagaatacaaatggcctttgtaagatgcaaatatcttaccaacatcatctttggaatctccatcgaatgtgaatccatatttcttctgtgcaattagttctgttgaagatatatttctgcagaaggcttttgattgaaataatacacataattcaattgatttcttctctcctgttatcttgtagacatcagcacaatcacctaattttggttccatccagcaggttccacatgtgcaaccggtacctattgagaaacatccggatccgtcacaagaccaactacttgtatcttctgacgaaattattttgttgttcacagtttttgaaccaagtttgtctttacacttgtcacaattttctgtacaagtatcggtgctttcatatttc

SEQ ID NO: 230 - DNA, 861 bp, Colobopsis shohki virus 1
  Kumejima-Csh RNA, complete genome.2
aagaccaataagagctctatggaatgaacatgtagagcaatgtccaaattgcaaatatgtttattctgttttacgcagaccatatatagttccttcagttccttatttcagcactccaaaattccaaacttcagaaacctcatttccttttcctgaattcactaaacccataagaaaagaagaaaaatcgtcttctggtgaagatactgttgatgattaagtattctttatgagttgcagtctcttactctgcactgtgtctaggtggaaactatcagcacagtaaataagtgaatgtaacaagtttggtggatacttgtcggactgacgttataattcaccctgtatgtttggcgaaaaccctatcgtcttcatatggaagttctccttgtcacagaacaaatatgggttgcccccagcattaaccactaagcgtttaagagctcatgtctctctttagagatttgatgtatgagcaactctcccggggaggagaatttaggctgactcctaccaaggttggatcttgtgatacgtagcaagtataggatgatggctaattcttttattaaattcagaaggactagcaatctggatgaatttaccggatccgtagagtcatgtgtttaatgtaatgggggttactgtatactcgtgtgggtcgactatgcagaaagggggatctcgccatagagatgtcctgtacccattcttgcggtggacacatcgtacttaaattttaaatgtatttaatgctattattttgctgctttttgctagttatttgcttattttattgctattaataaccattttgctgactaagttgctttcgttaagttatattgctattcaactacg

SEQ ID NO: 231 - DNA, 863 bp, Culex mononega like virus 2
  isolate OTU6 RNA-dependent RNA1
ggatcgatgaaggagatcctgggaattagtcttagaaaaacccgacagttactagtcaagcaatcatgaactatataacgccgacgattttggttgccgtcattgtgatcgcccatacagtggccattcggtcactgtcttacgacatgacggacagggtacctgtgatcgccctcatcaatgaccacgcttcgtggtttatgaaattgaccgtcagcccggtgactatcaatttttacgcgacgctgacctccttcttcgccaccttagccctgatgggtgtggtggtcaaaaattggcgggcgtatgtccgggacatacaacgaggggtggtgagggcggaagtgttgatgaggtcagcgtgactgcgctggtctgcttctagtttctccctgagagagttaatctgtggaacccgggatctcctgaggcggacacacgacagcattgtgcagcttacatcttgcataagatgctgtcgtgcttattttgagcgaattaaactcctcaattctgccgaagcagggggatcctagatttcaactagttattctctcagaggaatagtttggtttattttgttagtttcattgtttttttatgcatagttctatgtgtgtttgtttgttacacatattttgttttatatatatacacatgtatttttgatgttggtcatgtttgtctagcaattcggagccctatacactcatcttccctgattctaaattctctgtagaaattcacatatatgtgtatatgtatatatattttgatactgacctgctctacaaggagcttataacaaattgagaagtggcatatcttcttagaaaaacccgctagttactattcaaatcaaa

SEQ ID NO: 232 - DNA, 867 bp, Dicistroviridae sp.
  isolate wwb174dic01 genomic sequence.1
ttaaatagaatccagatcaattcgaagctttttaagtagccgatgtgtagaattttagtattgtccattttatagggtacagatcaattcgaaactataattgtaggtggccgtcacaagagcaaacaaaggtagatttattagagtccagatcaattcgaagctaataagtcaaaattataacaagttgaataactttaaaatattcaaaatcaaatttatttaaagaatagtactctctttttcgatagaatgttttaggaaaagagctcaatattactttattgttttcaaattattatgttttaacacaaaatatatttttgatagtagtgacagtctatttctctgtctaatgtcgatttcccgttatatgtggatcctagtgtgaattactagtaaaattttattccgtgtgcattcgtataatgtacttattgtttcaggcgatttagtaatgctgtttcaataatattaagaactaagattatttctatattctaatcaaagataaaatatagactcttgttatgaggaaagttttcccctctttcaagttttaataacgaaacaaatatagcaggttatttgttgaacgatcggtagttactccgatgattcgattacttccccttgacccaactttggttgaacttttagttcaggtatatgttgcattttccacgtgtgagaagcgtgttcttaagtgaaaggtaagttaggaaagaatttagtgttgcaaataatatagtgttatgtttcctcaaaccaggtgtgttcccctcgtttgttgtatttttagggcatccgtaattaaaggattttaattaattaaataagtacaccattaatgtaaatttttgttgt

SEQ ID NO: 233 - DNA, 892 bp, Achimota virus 1
  complete genome.1
caggagttcagcaacaagttcagaactcaagagacgccatcggagagagtttgatcttagatggactggaagaagaccccatgtcagtgaatggtgcaaccccatatgtgccccaatcactccaatcccacggagatttacatgccgctgtggagactgccctgatgtctgccccatgtgtgagggagattttaaggtacttaaaattgctggagaaccgttttaatcaaatggattggaagttggacaagctgattggacaacagagtacaataacccaaattaggaatgaacagatgggactaaaagctaatatggctatgatagaggggttgattacctctatcaaaatcatggatcctggggttggtactggagcaaacgccgcacaggccaaaaaattgttcaaagaagtgccggttgttattagtggtcctgttgtgggagagaacccattggtgacagctactgagcttgagatccaagatcttggcaaaccagcaataccatctaaagggagttcgaaaaaggctggactgactgaagcagatttggctgggtacaagatgaccctgatgacattgatcaaggattgcattcccaatgcttcgatgcaacaagagtttgagaggagagtaaatcaaatcaagaatgaagttgatttcaaggcgctcaagagagagatattaagagctgctgtctaagaagaatccaaattatgcttagtacccatactgcaaggctttcaaggaatcatgctgcttaaatagtgcacataatcaatacattccatgcaaacaaatgacatcctgattagtagatatagttaatttgcaatttaagaaaaaaccaaaagtgggcccggacccatcaagcccaggagccctcaacc

SEQ ID NO: 234 - DNA, 898 bp, Norway nairovirus 1
  isolate NOR/A2/Bronnoya/2014 nucleocapsid1
ctcgaagatatctaacccccgagaattacaaaccattcaaccaagagaacgggaagtggcatctgcctcggggacacttccttgtgaagtttagattcagagattcaaccttagtcatctcaagggattcacctctttctcaaaccctcttacagagaagttggctcactgtagaccaagtggagagtgaccaaccgtggatcccaacttaattgctctagtcatttaccttttgagcttgatctccattacagtttatcacctgtcaggtcccaactggccaagaataactgagaaagaagaggggccaagagacatacccaggcttctacaggagaatccctgccaactagtctctttccagaagctagtcactccaggaagaagtgtctgtgtaacctcacagaaaacaaagccaggaaacaggagtccagcagaaactctgggtgaggtccaggctgatgaagctgacgaactgatctgtgtagttgaacaacaactgcaagacttgggtgccaatgctgtcgctttggtagatcagaaagcaaaaggactccaggaaagactagtaagcacgtggaactacagcgaagataacctctcaacatcgccagtgttctggctggttatacttgtgttggctggttttctggtgctccgcagttctaatccaaggtacatccctagctgtccgagctgctgtaacaagtcagcaggtgaaagaaaagtagtgtacctagagtctgtacacactcagacgggaagaccaagaaggaaaagctcgagtactcaaaccgaagcagtccctgagaggataagccggtcatctcaaacagaaggaccactgacaaatccagtgcgagaaagtctacagctgctggaaatctgaccaatcaca

SEQ ID NO: 235 - DNA, 908 bp, Shahe picorna-like virus 3
  strain SHWC13623 hypothetical protein 11
cgcggcaacgcgtacgtagagtctgtctcgatttggggtttaaccacccctggttcttctgatcaatatatatatgtagcaatggttttccttgtgttattttacgaatgatcacaagatttaaaacccctacatgtatgcatatcgagcagacaggttttttgagcgctagcagtcgatctactgccaccaacggattttaccaattcaatcctaacagcaattggaccgcgccccccttcgggggggcgcattcaggcactttgtgccgccgctttatgcggtttaagatgcatttgcatctggaatatcccgggattccactagaacaccgatttaacggtaccggggaccccccgcttatgcggggggtctcggcccatctgggccaaagatcttacgtcgatctcaacagcacgtaaacacgctctcccatcaacgggattgagcacttcttatacctttgaagtaaatttgggaacctttctacttccagtgatagtgaatcacaggacaatctgttcacggaacagggtacttacggatccaccgtaagcgtgaaattagtttggggagcgaaataccccatttgaccgtagttacgcactcgcgaagatgcacttacgtgcgtcttgcgaggaaaaaaatatctcgtgtggttacgcggtttgatgtaaaccacctgttgagagtctcatgatactcgtccggtacgccgggtagacaggacaggtccctgcaagccataaccttaaactggtaggttgcctcacatggtttttgaaatacatgctgtggaggctttccctattggataataaagcacgtgaccgacaattgataccaccttcgcggtggtatcaatcgtcggaaaatttcctccaagaagttttccggtgattgatatc

SEQ ID NO: 236 - DNA, 909 bp, Hubei picorna-like virus 2
  strain WHBL73152 hypothetical protein 11
tgcaggtttccttttataggagacctgcacgtgtttttgtcgagatgaagagtagctgctcttctcagtattattgtatgatattttcattcatattctgcgttattttggataactaagaattggtgtaatttcacagtagtactgtgatttgcacttttttcttaccaatctgcgtatgaatccctgtttgggtttacatacacattttatttgaattcgacaatgaagtttagcaacttctttctgaaaactagctagagttcgacgatctctctggctaatgacaaataaccaatcaaaaagtcaaatgttcatgtatatatatatttagtagtgacctttatttagaaaaactttagatgatttatcgtcaagttgccctttgtgaagcgatcagctttttatatcgtttcatttttgtatacgtcttaattgacgttgtaagtacgttttgcatacctcacattgaggatagtatcgtttcctgactaagaagttaaactagtctaccaatagcaaccatataggatatagctttgtttttaacaaggtttaatctgatcttatgctcttgcttacggtgttttatgtatagaaaaatttttataaaaactacataattgtcaaaagaaaaagcgttacgtactgacgcatttatgttcacagtgtgacacaaaccttctatattttgattgtaaaataggctttgcctgaccatttatcaaatacaaactgtttcaaacgcctctccgagccatattggccgacgcgaatcgacataacagggtgagtttacagctgcagttgcagccgaggatccacttatttgagagagaattactcttaacgaaattttgaagtcacttctacacagttaagtctgagtaggcgttatccaaacgtaaa

SEQ ID NO: 237 - DNA, 911 bp, Changjiang polero-like virus 1
  strain CJLX30310 hypothetical2
aggaagctccacacaccctagccagtaacagttgttgcaatagctggaagggtaaagccaacgaaagcacaaactggacacacatttcttaatcggggttctgtccgggataatcgtaaccacccccgtcatcgcgtttgtgctatatagatttgtctaccttcctatccaggccaatatcagaggtcttgtcaacgaatatggccgtggctaggactaataggagaagacgtatgcggcgacttcgtcgcccccaaagagcgcgaccacccgttgtggtcgtagcggcgccacctggccgccggcgccggcaggcaccggctcagcgcccaggtgctagtagtatgtcccaagaaacctttgtgttttccaaggacagcctggctgggaacgcttcaggcgttctcacctttggaccgagcctcactgattgtgcagccttttcctcgggaatcctaaaggcttaccatgagtatcgtattaccatggtgcttctggagtacatcacagaagcctctagcaccgcttatgggtccatagcatacgagctggatccacattgtaagattaccagcctctcatccaccgtcaacaaattcggagtcacgaagaacggtcggaggagcttctcccggcgccaaattaatggcaccgagtggcacgatgcaacggaggaccaattccggatcctttataagggtaatggcgattcgaagatcgccgggtcttttcgtgtcacgattcgggttgagactcaaaacccgaaataggtagacgagagctcgcctcccactcccacaccagagccgactccggctccacctcaaccagaacccaccccctgcccccctgctaaacaagacagattttggggttatgagggtgtaccacaatcgaaaatttcctcgggc

SEQ ID NO: 238 - DNA, 930 bp, Solanum nodiflorum mottle virus
  culture-collection ATCC:PV-491,1
ctgcttgggatccgaccgatctcctaatgctaaaaccctccgctatggtccgtatgggcctggtagacccggccagagtgttcgtgaaacaagaaccccacaccaacaagaagctgagtgaaggtcgctataggctgatctcctcggtttccatcgtggaccagatcatcgaaagattgttatttggtccacagaaccagcttgagatagctacttggtcgaccataccgtctaaacccggtatgggcctaagtttgcggtcacaagctgagttgttgtggaatgatttgaagcataagcaccgactgagtcccgcgtctgaggcagacatttctggatttgattggtcggttcaagagtgggagctttggtctgatttaagcatgagggtaaatttgtgtgatgatatgcatgagggccttaagagattaatgatcaacaggtttaggtgctttatgttttcagttttccagttatccaacggagagctactagagcagacctcacctggaattatgaaatcaggttcttattgcacgtcctcgactaactccagaatcagatgcctcatgggcgtcctcattggctctccttggattgtagctatgggtgatgattctgtggaaggttgggtgaccggagctaaagagaagtacctcgagttaggtcatgtatgtaaggagtatagaccttgtgagaccaccagagatggtgagctatccaaggttaatttctgttcgcatgaactctctgagggaagattctggctcactagttgggccaagactctctataagttcctggactcacctaatgaatctcatgttgagttggagagagagctgagttctgggcccatgtggccccgcgtaaaacgttacttgtgtcaggtaggactgatccctgacaaaacattagaggaaaggaaag

SEQ ID NO: 239 - DNA, 936 bp, Red clover carlavirus A
  isolate B46, complete genome.2
gtttacaggcttgaaattgatatagtaagatacaggacaaatggccgatcaagatcaacgcaaacgcgagcaggaaatgaaagagagggcggcggaggagcaagctcgtcggaaggctcaagaaagcaagttgaaatcaccagaagcaaccggtagtggattgggtcattccatgatccaaacgcaacaacgattaactactctggaaggtctactgagggaggataggtctggcttgcaaatcacaaatgctagctttgaaaccgggagaccaccgttgcaaccaactgaagacatgagaggtgatccacaaaatatctacaacaggccatcaacagactttctgtgggaactgaaaccaaaacctgtttcaaacaatatggcaaattccgaagaaatgtcaaagatcaaagttaggctggaaggactgggtgtacccacagagtatgtatattcagtcattcttcaactggtgttcaagtgtgcaagtactagtagttcctcctatcaggatcctcaagggaccttcgaattcccaggtggtgctatcatggctgatgatgtggtgggaacagtgcaggagattgctggactccgtcgagtctgccgactctatgcgcccgtgacatggaattacatgcacctgcataataaaccaccttctgactgggcggctctgggttttcaatccagcactagatatgctgcatttgactgctttgactatgttgaaaatgaagcagctatcaaaccaagtggtggaatttcccctagacctagcagagctgaatatgtggcatacaacacgtataagcgacttgcgttggatcaagcgaataacaatgatacatatgcaaataatgattcggcaattactggtggtagaatgggtcctgaaattactaggaatttcaataatgcgaataataagaaact

SEQ ID NO: 240 - DNA, 942 bp, Dicistroviridae sp.
  isolate rfb199dic1 genomic sequence.1
ttataattatatcgtattaaaggattttcattagttgtcatggttaaatcataaatacttggctaaaatggtttcttcgacaagtatcgtgtaaagttcttaaaactaataatcgtccagatcaacggtcagtgtacaggcgtgacatcctaatctcggccttacattctccactccatacgggggaatgacgcccctctcctaagagtgccgagagcgccacatgtatgtcttaagtttcttaaactctcttcaattgtacgtagggtatgtccctacgtacaattgaagagagtttaagaaacttaagacatacatgtggcgctctcggcactcttaggagaggggcgtcattcccccgtatggagtggagaatgtaaggccgagattaggatgtcacgcctgtacactgaccgttgatctggacgattattagttttaagaactttacacgatacttgtcgaagaaaccattttagccaagtatttatgatttaaccatgacaactaatgaaaatcctttaatacgatataattataacctgacctttacttagtgatttcacaaacggatcccgggtgatttcacgcacgactaagttttataatttgataaagattatgcgagtaataggctcttttgtagcttttagtgcatgtttagaaatttatttgttagcgaccattgaaaagcgaccctcgatgattacgatcacagaggttagcctgtcaagacatttaaataacgaaccagcatgctatactaattgagcaataccctagtttatcagcgattgatatcaaaatataagattcctcggaatcaaggtagtcccggtaaattatatttgtagcgaagacccccggaactgtaagcgatacacgaatgaagacgacgattcaagacggaatcagaatgcctcgtgggcgtaaacacaaacc

SEQ ID NO: 241 - DNA, 943 bp, Changping Tick Virus 3
  strain CP1-3, complete genome.1
cgctgatagactcttagttttcgaccacatgcgcgcaacggaggttggtcgtgttctgttttaaaaacaaatcatgccggaaggcacagttttcagagatctcgttgttcgtttgcgctctattagtctccgctttgctagcctgaggcgttccgagccactgtgtacttccggtaccatcagtcaatcttgacgggcattcccctgagagattgaccagccagggggtaaccccggcagcgcgaggcgtcagccttcggcccgccgtcgcgctccaacgagatctccacgttcaccaggtcatccccatcgaccttccccccactctgacagctccccggaaagaggtgatctttccgtagaagatcggttgagcttgtcgacgacccaacgacgtcccagacctgtgttaggtgcagctggagtgtcttttgcaaaggccttgctctcaccgccccctggtcgccacgagccttgcccgccacccgctcgtcgtgtctcctcccctgagccacagccaggtccttccggctatctgagacacagcccgcgagaggttgccactccaggatccccacctgagtcaccctatctgaccccccgatcctctcctgaaccagacccggctggtctcttagccgaggaaggtcagggtgatcaggatcctgtggaagatcctgcgcttgtacagcacctcgccaggcttctcgagctaagcctagacctggagggagggatagaaggcggtgtgcaagctctgtttgcacaacaggaaggtgatcaagccgcaggaccagcccagccaccagcacccgaggccccccaagcggttgcagccccaccacctccgccgcggcccgatcgacgacagccagcggttcccgtcgcagttgcagcacctgctccaccagcccccgcagcagaaccggtcatccggccagcg

SEQ ID NO: 242 - DNA, 945 bp, Entoleuca hypovirus 1
  isolate 97-14, complete genome.1
tccgaattcccgggatccgcctttgagatcttcctaggaaggccacctaaggaacttgccatagcccgtgtgagtgcttttatgcattctcatcacagttttctctcttggagaactatggttaagtttaggatttcattggtgaggccagtgggtctcggtcaaggcacagtgagggcctgtgcgtggttgtctccctcctctcccgcaggggaagtaaaacatacttgcaccgggacgcgatgacgtccgttatgtggataaaccatctctttaattaaaactcatcaaccgggggttgcacccgattgcaagtcaccactagaaatgacgacgaaagtagaagggtggcagagaagatgaaaaggtcggcggctaagatggtgtcttcttagtttgctttaagcgcggcaattcaacattgtcccgtcagattggccgcaatgcctcaaccttcaatcgcttcgggtactgagctcgcggtaaaccattgtaaacggtaacgcgtaggagtatagcactcttgcgtagtccctagtcattaaggaattactgtctctttacactacaccaagtggtcgggtccgtagggcctgatctttagcctctccggctatcgctgcgtatactgcagtctgttagtaggagtcatttcgaaatggtgatcccattcatacgaccgtgacgaactgaagtcactgatgtctctaaaagctaactaaaatttagtctgcggggtcgcagtacggctccctcatcgatctttttctggatgtaaaactccgcgtctcatcgctcaagagtataaaaggaaattgaatggtgacagctggaaagacagcaccccaattcttcaagtggtcacaaacatcgagctttagtttgcaaccaccaccgtttcaagaatatcgccgtttcgcaataccgtaaattgccattttcaac

SEQ ID NO: 243 - DNA, 946 bp, Kummerowia striata marnavirus
  strain pt119-mar-10, complete genome.1
gctaactgtttgccctatatagacaagtgtttagccctttaccgagaactggactgcacggagaggtagtcctagctcgttacgttggtcttccttggtataggtcatcaatggttatttgatgagagctttgatgtaattggatagagacgttttactcagataggtgatttctgtccgacacgcatgtcggtaaatatcaccaactttcgggataaccggatcctttgttatttgggattgttatattcttttgctccggagcatttgatattttataacaatttgcaggtggcgctgcatttacccgtagccatataaatagttgtaattatattgtatatatatacaactggtcgtcacttaatttgatctgtagataattttgatacacaattttgtttacaggtctttactgatcagtctctctgcctaaagaggcagaactaaccgtaattaacggacgacccctatgagtggaggatccacttggcgcgacattagttcatggtcatggcgcattatatgacccccgaagggtggctcccgaaacagccttttttgatggtcggaaatgtacatgaatttatttatgtgctgagtacggacatcgcaccctccaggagtattggattattcgagctacctgacttagtatggtcacctctttctcaatagaaattgcatacaagagggtaagggttcatgacctacattatgttttgcataatgataccgttccgataccaaggcattatttggtggcaacatcattagtgctaatgattacctgtgccacaccgtcgaacgtgtgaaattatcaggaggaatctggggggacctgctgtgacaagatagttggggcgactttcccccgactcttcttgttactgcaggtgcttcaattcgttgaagcatttgcggtaacaaccatctctattatttc

SEQ ID NO: 244 - DNA, 956 bp, Garlic yellow virus
  isolate G83, complete genome.1
gtttacagtgtggtatattgataacaatgggaaacgagaatgaacaagacacagatccaaaacttgcagggcgaaaaggcactagaactgatgtaaacagccttgtccacacagaggagcaactcagggatccaaactacggccgtagacaagtgaatgacgttaatgtctctgaacacgattcttactctgaacttatgaagaagtacgaagatagattcaacaaactcaaagaaagctgcttcagggatctttcaagcgtgtcgatttcaaacagtggttgggaaactgggaggcccaaggctgtcattgctgacaatctaaaaggcgatgctgctaatatcttcacaaggccttcgatcgatgcattgctcgttcgtaatacagtacccgagtcaaataacatggccacagctgaagaattggccagaatatcagctaaggttcaagcactgggagctcctgaagaacatttggcagaggtcttttgggacgtggctaagtattgcgcaacagctggcagctcgccagctgtcaatccccagggtactattcagcttggtgggaggacaattacaagagacatggtgttcgctgttattaaagagtattcaacactccgtagagtttgcaggagttatgcacctattacttggaacaacatgcttttaaacaaccaacctccagcgaactgggatgctaaaggtttcactgaagacaccaagtttgcagcatttgacgtttttgatgccgttactaataaagctgctattcagcctctggaaggtctaattaggcacccgactcaggctgagcggattgcatatgccacccataagaagttggctctggaaaagagcgcacaaaatagcaggtatgccaacacttcggctgaagttactgggggcttgttcggctgttcccctcgcaacaatttccgtgagagtcgatgttaa

SEQ ID NO: 245 - DNA, 959 bp, Trichoderma harzianum hypovirus 1
  isolate THHV1.T-70, complete1
ttccaaaggatccactttgggaccccgcgttaaggtactatgattttgtacttacgtctcttggacgaccttaacatggtttatactctgtcgagttgctggtttcagtaattcagccacacattgtggttggccagcaggcggagtgtgatccagcttgggtgcaaccttcgttagctaatcgcagtagctaacctggggtgccctaaggccggaggaactcgttggttaagaataacccatttatcggtttcacaagctatgtagcctagatgatgttctcatcctacgtaaaactatgaaacgcgcagcttctcccacccctttagagagaggggaattggttgggtgcctagatcccaggagcactgagtagtgcactgtagctgatgttagacgttggtgtgaccatctgacattgtctctagccatgtccatcgaggttggcaacctaatgaggcctgggatgccttgtttcgcttctgacttcgcgatcagatcgttgactgagaacagtcgattaaacagcatgcattcttttgggtagatgtatgaaggtaaaagccgtaaagcgaccctcctcgactgatgcctttgtgccagcttgagagaactgaggacctggcgaagccagtgggtcaccttcaataggttcatggtgtgtgagttcatctcaccacaaacgttttccctctgtttagagattctggaatcgctagccgagaacggctgcccttgtattgctttggttctggtttatacgcttgagatcgtggaagttctcaaatccgaaatcaacgtgtgtagcacgaagacgtggtgtgcttgcacaagtcttcattctcaaggatagctgggttctttactagggcaaccccctagagccagccggttcggcacaagaacggtggaagatgtgggatgaaaactcctagcatcagaagtgcacttccatagat

SEQ ID NO: 246 - DNA, 993 bp, Beihai picorna-like virus 48
  strain BHZC37443 hypothetical protein1
atgcagtgtgttttacacactgcatgttatgttttggagagaaagtatttacgatatacttggatcctccgcttgattgcgtcggatcctttcatggtacattcactgcgagacataatgtaccataggaaggaattcgcaacatgacgaaggaagagtcaatttcgtggaatgccaattgatattacaattattttcatacgtctgtaacacgatacgtacaacccctaacttaatcgtaggttaccaacgcctacttcactgaatttatccacaataattcagtatttgtttagagtacctcaacactctatgtgtcgaagttgagacaggtttttaagtttgctctctgtatggttatttccgacagatgagcttacaatgcgttatgaagatgctatttttcctggagtcaatagtcgatgtcatttagacgtcgtgagatttataataaaaatgttagtcgtagctgctatgtgaaggcgtacgaccgaatgtttgaacgagattatcaggtttacttgatttatctacacttttgggcaactttgttgccatagcctcattttgattgtcgaattttgagtttgatctaaagattagacattgggactgattagtaaagaaaagacaagagttgatgggaattaactcgggacacgtcatacggtggacgtgaacgagttgcagggttctcatgatgtagagatacgtcataaaagggtgtggcacctcaaccacacttcgaaagctatcccctaagtgcatgggatgatatatttaagctgtttatgtttgcgccattgccatcgcttttgagccattggtggtaattcgcacattcctctatacagtggagattatttgaacttgtacattgagaagcgttacatactgtttgttggtcacggcagatgtatactcaaactttgattgaacattggaagaattgtcgaaatttcggtgataactcatgatttttggtgcttggaa

SEQ ID NO: 247 - DNA, 1000 bp, Papaya mottle associated virus
  isolate KE-Mer-04, complete genome.1
tttgacaaaaaaacctcaaaaagtgcagctactattgaaaatcataatatacgctcttgcagggattggcttctggatatgactcaagtgttttcaaagagccaattatgcactaaatttgacaaccgatttaggtcggcaaaggcagcgcaaacaattgtttgctttcagcacgcagtgctgtgtagatttgcgccttatatgaggtacatcgagatgaagttgaaggaatccttgccgaaaaagtattatatacattcaggcaagggcctagatgagctgaacgattgggtcatcaagaacaagtttgacggcacttgcaccgaatcagattatgaggcctttgatgcttcacaagatcagtacattgtcgccttcgaattagagctaatgaggtacctcggtttacccaacgatttgatcgctgactatgaattcatcaagctgcacttgggatccaaacttggatcattcgcaattatgagattcacaggggaagcaagcactttcctattcaacactatggcaaacatgctctttacttttttgaggtatgacattaagggcaacgagagcatatgttttgctggtgatgatatgtgttcatcaaagcggctaacagtcaaaagagaattcgaaagcttcctatctatgatcaaactgaaggctaaagtgcaacatactaaaaatcccactttttgtggttggcacttgtgtccagaagggatttacaaaaaaccgcaattggtcttcgaaaggatgtgcatagctagggaaaccaacaatttacacaattgcattgacaattatgctattgaggtttcctacgcttatcggaagggtgaactgattacagcaagaatggatgaggaggagctgggggcatattatggctgtgttcgaactataatcaaacacaagcacctcttaaaatcagatgtcaagaagttattcgaaggtgcaacgatgtgatcttaggttgtagatatttaaattgaat

SEQ ID NO: 248 - DNA, 1000 bp, Sclerotium rolfsii mycovirus dsRNA 1
  strain BLH-1-16 hypothetical1
ttttcgtttgaggtacgaaagacgatgcgagccgaaagcgtcacttagaaccttgtccgttagattgattttgataacccagaaaaaacgtgccacgggtaacaacacgctaaacaactggaatctgctttacagtcaaagcagcaaagaccagcgacctaacacctttaagaaagaccgacttgtgctggggaaccgcctactcagcttttcaccggaacccgaagccttagcgattttacgaatcgaacgcgctactgaacgatagtgctcttttccaactgcgtatgagcataatgacgcatgccccaaagcgtcaatctcgtatcgaaacaaatgactcgagacgggttatcaccaaagtgacactaccacttttgccttagatgtcccaacagagaaagatagcgtgtaaggggcggctaccaccacaggatatagcagccgcaggtgttcgtcgccgggagacgcgccttgctgaggaccgaacgacgaaataaagtaggacctgactcgtctcgcaatgactgttttcagatgccgtggacttttgacgagtctcgcgcgtatggtccgaacgcggggatcgaaaggagccacacgtatcttgcattggtcttacgcatacacgtaatactaccatctattggtcttacgcatggagatcacacgtaacaccgcatgttgccgaggcgtaactctcggtgcaaggcgtgggtgagtggccggccgaagcctcatcagtctcgctgcgctaaggcaaacgacggactggtgtgagaaagggaggagagagggatcctgagtaacgacagactacggtaggaaggaatgtaagggtggggcttaggaacgaatcgaaagcccgcggtgtggaaacttggaggaaagaataggacttaggacgaatcgaaagcccagggtgtggagttactcactacctccccgctactacaccgccaaggatgttggatcgttcctgcctcaggcaaggatcggt

SEQ ID NO: 249 - DNA, 1000 bp, Rosellinia necatrix fusagravirus 1
  genes for hypothetical protein,1
aagaaaatgaagactgtggtcattttcttccaccaacctcactctccctacggggagtgttcaggctggtgttcaaaatcacagtacacacatgcttgaagtgtgacaagggcgggctccggtccgcggctaaactttggccgtactctgtattacagtttgcctaagtatgctgatagctcaaatcgggaagtggtttggtggaccagagcccgttattcacacaccacacgatccaggacggctctggctaaggcgatccaggatgcgtataaacccactgccaattagctgaaccgccgactaggggatccgcgacatcgtctgggcctgtagcgtaccgtcatcactcttttaaggtacgcgcctgtgtctgggccgtcaactgcggggctggagcttagcgtctagctgcggcgttagtctgttttactgtttacgttgtaggcagtactaagacacacctcctaattttacacttttccaacctactcagcttgccgctttggttgggaagttcttaaaatgagctcctattttatagagctcaagtaacttttgtgcttataatccatcaatgtctcaggctgacaataaacgcggctccggtacatcggcggcgtgtgctcccggaatcataattagccgcaaatccttcctgtttggtcattgtgaccatccattggggtaactctcttttgaggggtgtggtcaaggcgaactcggatagctgaagactgctaacgtagtgcacatcaccgacttgaagatgtgttcgaacgtgccagggcacagcagcttaggctggcttccttggtggacagactgacacccattggggacctcttcctcacggtaagcgctcacgctcaacttccttcgacctgctatgcattcacatttatgtgaaataagtctccgctaactgaacgaaaccgagatagacgaaacttatttggtaagtccgcagcaaacagtcgcacgggttttaggcccgtgg

SEQ ID NO: 250 - DNA, 1000 bp, Fusarium virguliforme dsRNA mycovirus 2
  putative structural/gag1
ggccaaccattgatatcttctttaactcccttggctgggttacagctgggatatctaagtgctacccaccatacaagcatgccctcactgcgggagcagtgcttcagctagttggccgcctaactggagtagttacaggccctttaaggagtcgggtcaccccttatagtatacagacccgtgccaggtttaacgagcctggctactactagttgtgtgcatggacctccgcaatcaatgcattctatttcctgcggctctaatcggtgtgactaaccgttggagtataaaagtcgggtcacatagtactacatctggccgcggcgcggtatcttgccccacacttattatttaccgccgtgcttcggaattacagatcggagaggcttctgcgctcttctgtgcccctcaggagtgagatctaactatgtctcatgtgtagttaactactccgcgtactctcattttccacctctgcaagaaaactaccagcggagggagcagtgaataaattgagctgcacgtctcgaggaaagccgggacgttaaactaggcccgcgcatcgaaggcgctcaacatgaggctagcttcggcaaaggcttaaccgttgcaatcaccccgtcgcggcctgggccccgggtcgcgattcgccagctgctggttcatcatgcagttaggggccccatggaatagtctatgcgttagcatgcggagcacttagtcccggtacagttgacagtaagtcaaagggattgctcttagcatgtggctggaacgggttttatgtccgtgcgaggagtgggaggatccccacccgagtgtaacgactgcgaagtcttaactagcgtgtaggaacagtctctctcgaagtgatgactcgaggggtaggccaccgttccaatcttcagtggtgtccttgcttataggcgtcactttaatcccaaaaatttctaagcagagagtagtgttagtagcattattctcgaaaccaaatttaaaa

SEQ ID NO: 251 - DNA, 1000 bp, Rosellinia necatrix fusagravirus 3
  genes for putative structural1
gcggtttaaggagaagtgccagactctggacgtttcctcacacgcacgacaggctcggctgttgtgcgtgcttatcaaaccgagactctggtgcaagagggcttcttgtagcaccagcgaacgctagtggtggtgaagccagttcttatttgaatggttggctgacgagatgagaccggcgtacttgaagcttggacctctggtaagaggtgataaataactactcgcagatccctggcgtcagttcagtgggcaggaaggctggaaggccttgtggggtttatcgtcacgcagagcggtttggctcgctgtggccccacactacgcactctaaggtctcaataccgcgtggcgtaggccagcttttatagcgatttatctcctgaatactccgagcttcgagtttcggaggttggagtaaatttagcgttacctccgcgggcggcacgcggtttagcaaatatgcctaaaactggacctcgcattcaatcaggtgcttgcgagtcgcctaacacgtgggttgaaccttcgggatcccctttaccgccgcgaggtggagtgtaaccctgcgccatagtgactcagagacagaccctgccccttcaccctcaaaagtgataccgcgggattctggtgagtggaacgggaggtggaatccgcaaggcccaccacgcttgtccgtgcaagggaacacgcttgcaacttggagtgccaccgcgtaggcggcagacaggaatttattctctgtcgttcggcgatatcctaatacagttgtaatgcagtttccgagtgtaacgactgcgaactccttattctgagtaactgaacagtctctgacccaggcctcaagtgggcatacagtggggagggtgctatcatggctttcctttgcggatcgtcgatttcttcggttatttattagccgtcgtacaactcagaatcgtcctctttagagacggggtagcaacctagatagctatatattttctaactcacaaaa

SEQ ID NO: 252 - DNA, 1000 bp, Sclerotinia sclerotiorum dsRNA mycovirus-L
  RdRp gene for RNA1
acgcttatgctggcatgtccctagtgccggtagatttctcaccagttagcatggcagattacaaacccgctagcaacctcactttcccatccctcactcgtccgagcgcagtggatacaagcgacgtcgctaggaacccgcgagtagctagctctaaacgagctcctcgcgctgcagcttctgatattttaaacaggtttaaagagtttaacgcaccaccaccacccgaacccgcgcccgcacagtatgataatgacgcgccggctgcccagctgagctacgaggctaaataccccgttgaacaggcccaggttccaggtgatttcaaatattaccaacctgtggtggcagaagaccgagtacatgtggaacctgctgcagcgcctgatgcttacgatcgcttatctaagcaacaactgaaattagcgatcgaaaacaacatgcaactcttggctaagattcaaaactcacctattctaggtgagttagatttagatgctgaacgtaaacgccaggatgagttccgtcagcttgaagccacgcgtaatgcgcgaattcaacgcaggtctagctacgtaccttttggtcctgctcgtccacgcccggtgctcagccctcgctctacgccgaacaaacctcctgtcgtgcatggcaaactctctgaaaacgaagttaaccatgcacctgtagaggttaacgatgctgctgctgaacaggttcagcgtgaagttcgatctctaggtcgaccgataccaccgcctactaccgcggatccttttgccactctcgctagtgataagcgccgcccaggcacttattatcagaagaatgaggctactctcaatttcgatgacttggtaaaggagcagctcccagcaactaactttggacatactggcgcggacgttaacgtgcaggatgggatggcaactgactcactagcgaaaaactagtgtggaacgttgcttattaccgctctgcgcgtaacgttctcgccagt

SEQ ID NO: 253 - DNA, 1000 bp, Sclerotinia sclerotiorum hypovirus 6
  strain BLH-1-1 polyprotein1
ggcgacctccttccggcacgtcgtagacggcgaccggattaatcaatacagctagtacttctcagcacgctatagcgcagagaacaccaggggacgtcagggagaacgaagcacgtcgcgacctcgcgaggtttctacctccaaggggggctgcaggctaaggccgtatgaacgttgtactcccgcattttggatagatactgatcacgtgcgtccagcgaatcacgagatccctcgtccctgtagacgttaaatggcagcgcaggcggcgacaccgccctttcggttcttactaatcaccgcatccataaaagcggagataggcatgggtgtccaattaatcagtatgagatgggcagtgccgatcgctagcggcccacgggtctgacgatagcgttccgaaaggaaaagggctgatatcagatatcagatatataggccggcccacgtccgtagttccggctgtgtgcaaaccggtggcctagcttgggacttcgatcaccccaatgacgccatgaaaacgattcatccaattcttgctgtgttaacggtttatcttgggcgatagagccaactagctaagatcgtggtgaaatggttcgccttcgtggatcctcccgacactgtggtttcgacaccacaggtgctttcgaacttgaacttttatgcaattaccggcgcgggagcgccacattttggagtcgagactaagattacatcagttctatatgacgtagccacagagagcttgcgcctctcgcgttggacagcttatgccagtgactaacgatatcagatgaagctctgcgggatcttcggtgaaccaacttctttacctgtacgaaataaagggatctgtacctcgtcttgcgtgtctgaacgggaccgaaaatcgacttctaatgtagcagtttgcgtatggaagggatggcttgatagtgcggtttggaggtggtagcgtaggttgaaagagttctagggaacaaaacctccatacaat

SEQ ID NO: 254 - DNA, 1000 bp, Nodaviridae sp.
  isolate dwb062nod1 genomic sequence.1
taagttgggcgctggaatagcgaaatccattaaagaaacttatggtgctcctaaatgtagagcgccggttggttacgcagcagtgcaatctactgaagacggccgtatattgcacttggttaccaaagctgtgagtagtgttccagctattaaacagaggaatgcatatactaagttcacggctgccctcttgcatgcttgtgaattatctatttctaaggaaataggtgtgccgaacggaataggttgtggcttagacaaattagatgcgaatatagttcggaatatactcgctgaagttggtcacatgaggggtaaggtctttgtaatttacaataatgcttaagtcagctattgatgtagcatttaaagctgtccgtgcttcagctaaaagtgcgttgacggcttggagagtgacgcctaatccaacgatggttgttgctaaaacaaaggtcggatccttggtccaaaccgttgccttagaactaagacaaagagcaatcaggcgcgaacatctaaacttatggaagcatcgcccagttcagccggttggttatataactgccatggtgcccaggcccaccctgcttaatagatttgttgaacatgtcttaagtaagttaatgtctgctataagggttattaaaacctatacatttaggttggtagcattaacagggacgggactttactggctcttttcaaccctcattcaggggccagcagttgtagttggtggcacctgtagtagaatatggcaagcaattgtcaggttctattataggcttaaagcccgatttaaaaggagtaagattaaaggaaccaatcggttcagaaaattagcgtcgaaggctgattataggataagagcagcatatatactctatcgagttaccaaacatagagttgctgatgcagttcaattctactccaagaaactggcgcgtatggcttgggacaagcaagcatacttttggtggacagctctgggagcagaaac

SEQ ID NO: 255 - DNA, 1000 bp, Heracleum latent virus
  RNA binding protein gene.1
gtcctgagattcttcttgtggcctgaggagttaatacaagagtacaaaacactgaaactcatgatgggttgctccatgggagatctggcaataatgcgattctctggggagttcgggacattcttcttcaacactatctgcaacatggccttcacctgcctgacatacaacatcaggagggagacccccatttgttatgcaggggatgatatgtatgcgcctggagcacttgtggttagaaaggattatgagaaggtgctgggtgaactacagttgaaggccaaagtgaatgtcagttgttcaccacttttttgcggatggcggatgagtccctacggcattgtgaaggatccgaatctcttgttggatagatggaagatagccaagttctccggaaacctcgagaactgttttgtgaattacgcggtcgaggccatctatggatacaggttaggcgagatcctctatgacatcaatatcgatatcgatgcgcagcaagaattggtgagagagattgtgctggttaaacacaagctgccagcggccatagctaagtatttctctagcgacgtcaatgaagcgcattccgacggagaggaggtagatctacatctgagccctgaaggtgaactacttgattacactgatgccagagggagaggtggcactttttctaagtgggtcaaaggaaaagggaagatcaggtgaggaaaaaataaattaaaaccgaataaaaatagaggtgtgtagaaggttacttagctacggggtaactgctgacctctttaagttaggtgtgaataaaaacctaataatatagaaaccatcttacgtgtttgtgacttgttactgtctgattacggattgaatagagagagcgtagtgaggttactctcagaagtggacgcgaaggaagcggggaaaccggctctgagtttcaagagcctgatttgcaatctttgccgtggggtatcgccttccaacctgagtttacgaacga

SEQ ID NO: 256 - DNA, 1000 bp, Pepper vein yellows virus
  genomic RNA, complete genome.1
ctagtagatcaattggtagcccgggttctgttccaaaaccagaacaagcgagaaatcgctctttggagggcaaatccctcaaaacccggttttggcttatctacggatgagcaagtgctggagtttgtacaggctctggccgcacaagtggaagtctcaccagaagaaatgattacctcgtgggagaagtaccttgtgccaactgattgctccggctttgactggagcgttgcggaatggatgctacatgacgatatggtcgtccgcaataaactcacactggacttaaatcctacaacggagaagttacgatctgcgtggctaaaatgcatctgcaatagtgtcctgtgtttgagcgatggcactctcctcgcccaaagggtccccggcgttcagaagtctggtagctacaacacaagtagttcaaattcaaggatccgagttatggccgcctaccactgtggggctgactgggccatggcgatgggagatgatgcccttgaatcagtcaacaccaacctagaggtgtataaaagtctaggtttcaaagtcgaggtttcaggacaactggaattctgctctcacatttttagagcgcctgacctcgcccttcccgtgaatgagcgcaaaatgctgtataagctcatcttcggatacaatccgggaagtgggaatctggaagtagtcgcgaactacattgccgcctgcgtatcagttctgaatgaactgcggcatgacccagatttagttgctctccttcactcgtggctagtctctccagtgctgccacaaaataattgaagagagagccgataactagccaagcatacatcagttgcaagcgttggaaagttttagtctgattaccaacagcctgacataatagattataaatttttagcaggatttgcgtttggattcttatccgcaatcccaatttctgtagcaggcatatacctagtctaccttaagatctcagcccacgttcgcgcaatcgtta

SEQ ID NO: 257 - DNA, 1000 bp, Avian avulavirus 20
  isolate AAvV-20/great black headed1
ccccagattatgttggcagcacaggcaaccaaagtgcagtgaatgtccatctggatcattctggattcctgggcacagaagagaatatgcattttccacaaataatggcctcacatacctctccagctggtgtaacccagtctgttctccagtcagaacaaatccaagagtcgagcaatgcagatgcggctattgtccatcagtctgcatcctatgcagagacgattcttcatagtgattccatggtgctgggtcggcttgcgaaaattgatgaaaaattatcagagattatgaagataataggaattataccatctatcaagaatgatattaatcagctcaaagctacaactgcccttcttagcaaccaacttgcagctattcaaatattggacccagggaatgctcagtgcaaatcactgaatgagatgcgagctgcatcaaggagtgctactgttgttgtatcaggcccaggagaactatctccacagttagtgagtgataaacttatatgtaaaaatgagctgggccaaccaattcccagagaggaatatagagccagtcaaccgaccaaatcatcgcccaatatggttacagatgctgagctagagagtttacaagcactcattgagacactggtagaacctgggaaaaagagggatagactagtctcacagctcaccaaagttaagactaaagatgattggaatagacttaaacgcgcaatctacaattcataactgtgaattcacgcctgcaactggaacattataaatgcctgacttaacacattaatccctataatcaccttacgctttaagttagctagataggatccttttcttgataccatttttctctctattactctctgaccttaccaaattataaatgtctctgagttacacgcctaatctcctgtacaattaataaaaaagaataacttgggggcgaccctatccacaccggcccagagaccccacagactcccaaactcacc

SEQ ID NO: 258 - DNA, 1000 bp, Mossman virus
  complete genome.1
ataatggataagctcaagatcctagatgagatcaagcatgatgtagagagcatcaggaagacagttatgaagcatagtctgtctctcgcaactctggaagggcagttgagctcggtaatgattgcagtcccttcaactgggtcccaaccacatcaagtagaggtgaatcaggaccttaggcccctgcttgggcgagacaagggaagagggatccctgaagttggaaaaatgaaagtccaaacagtttcgtttgatgagcccaatcaatcaaggagtagtcgtgctcaactgccgaagattagagttgagcttgataagaagatactccctcctccaattgactcaagcaaaactaatgcaacaggatacaaacctgctcctactctaatctcaaaggaagtgatcatagcactgattgattctcggattaaggacaaggatatgaacactagaatgaggaggctacttaatacagccaagacacagagagaactagtggagatacataaggcaatcatcagtgctttaaagaatcaaggcagctaagcaacagtcagtttccattgggtatcaggtaaatttgatacgacattgcttgatacaaaactaaaaagtcaaatttagaatattcatcttagactacattagccctataaagtcagtagctcccttaatagattattggatacactccttagggtgatatcagttcaagataagcttcaaactaactcaggggtttatagaaaaatcggctggtattgacttgaatatttaaagatttctcaacatgttttcggtaataaagtatagtcaaccagcaccacaagtatcgtacttttagaggggatgatctttacacttatcaaagaccagaatactaatattaatctagtattgcttagctaaattagaccttaagatacatgcaacttactggccgctaatagcatattacaaaaaacttaggacgcaggtccatccctttactccagcaacc

SEQ ID NO: 259 - DNA, 1000 bp, Rinderpest virus
  (strain Kabete O), complete genome.1
tggtgccgccgatcccctctcaggagaggccaactgcatcagagaaacccattaaaaagggcacagacgtgaaatcgacctcatctggaacgatggccgagtcttcatcgacaggtggtgcaacccgacctgctctaaagtcacagtggggaccgtcagggccaaatgcatctgcggagaatgccctcgcgtctgcgagcaatgtatcaccgactcagggatcgaaaacagaatctggtaccacaacctcgcggatatcccagagtaacattgagcctgaggatgattacgatgatgagctgttctcggatatccaagacatcaaaacagctctagctaaattgcatgatgaccagcaaattataattaccaggttagagtcactgctttcgctcaagggagagattgattcgatcaagaagcaaatcagtaagcagaacattagcatctctaccatagaaggccatctctccagcgtcatgatcgcaatcccgggatttggcaaggatcccaacgatcccactgccgatgtcgacatcaaccctgatctgagacccataattggtcgggactccgggagagcccttgctgaagtactcaaaaagccggcctcagaaaggcaatccaaggacactggcaaattagggatcgagtccaaaggcctgttgaagaaagagttccaactgaaaccaatagaaaagaaatctagttcggctatcagattcgtcccggacggcagtgttgcatctcgcagtgtgatccgttcaatcatcaagtcaagtcatctcggggaggatcgcaaggattacctgatgagtctcttgaatgacattcagggctccaaggatcttgctcagttccatcagatgctggtcaaaattctaaagaactagactcggcacaacatagctgatctcctcgcttcccctcagcttagctacagcttgcatgctcattataaaaaacttaggagcaaagcataacgcctcgcactcccaac

SEQ ID NO: 260 - DNA, 1000 bp, Measles morbillivirus
  IC323-EGFP viral cRNA, complete genome.1
atgttcctccgcccccgaaccccagtagggccagcacttccgagacacccattaaaaagggcacagacgcgagattggcctcatttggaacggagatcgcgtctttattgacaggtggtgcaacccaatgtgctcgaaagtcaccctcggaaccatcagggccaggtgcacctgcggggaatgtccccgagtgtgtgagcaatgccgcactgatacaggagtggacacccgaatctggtaccacaatctccccgagatcccagaataatgaagaagggggagactattatgatgatgagctgttctccgatgtccaagacatcaaaacagccttggccaaaatacacgaggataatcagaagataatctccaagctagaatcattgctgttattgaagggagaagttgagtcaattaagaagcagatcaacaggcaaaatatcagcatatccaccctggaaggacacctctcaagcatcatgattgccattcctggacttgggaaggatcccaacgaccccactgcagatgtcgaactcaatcccgacctgaaacccatcataggcagagattcaggccgagcactggccgaagttctcaagaagcccgttgccagccgacaactccagggaatgactaatggacggaccagttccagaggacagctgctgaaggaatttcaactaaagccgatcgggaaaaaggtgagctcagccgtcgggtttgttcctgacaccggccctgcatcacgcagtgtaatccgctccattataaaatccagccggctagaggaggatcggaagcgttacctgatgactctccttgatgatatcaaaggagccaacgatcttgccaagttccaccagatgctgatgaagataataatgaagtagctacagctcaacttacctgccaaccccatgccagtcgacctaattagtacaacctaaatccattataaaaaacttaggagcaaagtgattgcctcctaagttccaca

SEQ ID NO: 261 - DNA, 1000 bp, Carpet python nidovirus 1
  strain F17-605-7, complete genome.1
tattgaaaaactctctctttttcaaccaacttaaccagttgtttgaccgcctgcacagtgggcacttgagtatatttttcatatccccaaacagtttagatccgtccaattattaaacaaacaaaacaattgaaatattttatttttattggcagagtagttaactgcttgtttgtcaattgtgtaccagcacaccaaccccttgccaacctccactcagagcccaggatatccccgaaaggggcttcctgctggtgtgagctcttggccccacccctctcaagactcgtaaaacagtctctacccagatattctgcgaaagtagaaatcactcaatctttctcccatagctacaccgagaacaggataaccccgaaaggggcatcctgcgggtagctctctgagcgtgccagtagatatcttcaccgactctgctgggcgtatcggaaccagtccgtcccaaagtccgcaaccatccaagtagctcgaacgagcgaaaggatagggagtacctccttagtaggcctcagccgaaaagggtgggaaacagcggcgaggcccttgtggcctgaccgcagaaacgacctggtagtcgcttctcaacaacagacccgactggatgtgaaaacgtccgatgtggtcagcttgtaactagctatatacttggatatccctcacaaggggactccaggggggaggaactgacccctcccctaggtatatagtaagcaaaaccaggggcgatctgcgaagacacccttcaccacacagccggagaacgctgagtgaagccaagaatcctgtccagcgtaagcacacagggacacattcttgaagaatacctcataactagcttaaggcggttatttggatccgaaagctgaccaccgtcactttcgtggaattctatctgacaccaacacagtcggaaggaattattacatttcaacccccaaaagggaaggtgcaagaacacagcacgaacaaaaattaactaact

SEQ ID NO: 262 - DNA, 1000 bp, Renmark bee virus 4
  isolate SA-10 polyprotein gene, complete cds.1
aaatccagcatcccccctgtggccccgcgcaggaaaggggataaagcgttagaaagtccgctttgttgacacacgtggataggttgagtggagagatatagccacttgatcgaatgtgttgaaagacacgctatgtatcactgacccccctaaggaatccagccgagaaactggatatcagtacgctcttttcaaaaaagagcaagaaagagagaagaagcacagacaatttgttaatagcagacccgctaaggttttcacaaaaacaaatttgaagtccgctaactctaaatcagccccggttaccaaagatccagctgttaccgttttgaataagaaaaagaaacacaagtttgatgataaagttgtcaaaactgtggatccttttgatatacaggatgaatcagaggttcccgtgattaatcctaatgagaattatgaagaattaggtcttgaaattcccagtcgccaagaggtcgttcccgaagaggtcatagctcaagaagcatttgaaaccctagatcaaggatcttgggatattgtacaagagtataccaaaactcaagaagatcttgatgatgagaaagtttttcttgaaagtttagccacagttcctcttacacctgttgaagaagataagaattatgaacctgaaccttttgaatatcaccctaactggagtgatcagtctcctgaagaggcgccaaagaaaccaaagttttcttttgagcctgagaccgtttcagattctgaagtcaaagaagagcttttaactgttaagaaaaagtctaatcctggactcgtagcttatagaaagaaagttgaagctcagcgcaaacaggttagagatgatcgccgtgaagagagagctcgtgccactgaatcagatattcgcaaaagtcgtgataacaagtacttaggagatcgcgagaatgctgaattcaatttccgtaacctgaagacaaagaagatacggtctaggacaaagaacacgactctt

SEQ ID NO: 263 - DNA, 1000 bp, Picornavirales sp.
  isolate H4_Bulk_46_scaffold_10 hypothetical2R
tttccagagatttgatgccctttggtctaatttgagtattgatttgtacctgcattcgcagggtgggtttatcccatgcaccccgggttcattgagttgatttatcctcattgttcccacccgtttttgttgacccgtctgattttgattagttagcattgccacccttgccagaggttttctggtatttctgcactattgtatcattcatgctagtttgatagtagtgccccctgattgaggaatgatcttattcctaccttcaggttcacaccgcctagtaataggcctattgactcactgtaaaaggaaatgtcgtacataccttgtgatattactgattaagaagctgcgttttggacacgcgagaaagtccagaattagtttttgaccattgttttgtatggggaaatgaccccctaggatccgccataataaagtgacgattattttaaaggagttgtttgaagcctcagtttaactgatagctgataatgacaccatcctgtataacttaaagaatatatagcgccccgtgaaactactcgaatggtgaatcgagaacgtaccgggggttagtattaacgccttattccttgagatgtgtcaggtagtgtttccgtctgccgcccgctataggaacgcgaggttaatcccttgcatacattgccccactactcaactcatagagtaagaaaaagacgtgagtccgtgtttttactatgtctatctaggttattcggtacttgatacgaggcaagagaggcacaggccccgagtatcaagtataaagctaaagtcctgttataccataatggatgcggcagacggctcagctgttgaccaagtagggttaccaattgagattactgaaattaacatatttgtagaagaattacattattcagtaccgtccccttcacaggagttccgatctttgtatcggcctgtgttggaagaagtgagatttgtgtctcgcttacacgtggaaagagacagc

SEQ ID NO: 264 - DNA, 1000 bp, Picornavirales sp.
  isolate RtRn-PicoV/YN2014 polyprotein gene,1
tggtaagatcagtggaaagcacaacaccgcttcccccgattatgtgacatctggcaagtgggcggatgggagcccctcagaatccctgtctctcttgacaggttgatttttaaatttcccatgccggacgaaggcgcttgcaataagtcaggcttattttcaggattctctttcttctcattcacgcgcgtcctatgcgtagtgagcggtttcgtgaggacccgttctcaggtgaccaccagacgcttgtttggaactatggcaccacctcaggtgtagactagtgaagacagtgtatctctacaggaaacctttggaggaaaagatttgtagtgcacctcttggaatagactgtgaaaacggttgagaccaagagctctgctatgtaaagaggctgtggagcaacgtgtggtaacacacgccacagtggccaaaagccaagtgggcagaaactctcttctaatatgctgtacccacggcagaagattggagagcaacgagttcaccctttacctccgcttcggcggctgcaatcctagtaacccaattgtggaatgtaccgacgaactgcctcaagctgtctgcattggtttgtgtaggaatgctatgcaggtaccctggttacaggatctgagcataggctaattgtctaagcaaacccaaaccaatttccccttttcttttccattggtgacgaactgcggatgtcgatatggcttcccaggcaattcacggtgttttcaacctcccaatggatcccctagaaggttttcagatgattagagtcttttattcccaaaataatttaaattttgatgagtattgcgcatctgttgtgcgcacttatccagctgttttgcaagaattggctccttttgttagagaaccggatcgtttcgtactcttttgtgctctttggtggcaagccaatcacgatgagggttatgagactgatccagaacccgaaccagaacaacagagttcggatgaagaagaacca

SEQ ID NO: 265 - DNA, 1000 bp, Picoa juniperi mycovirus 2
  isolate ANK_VIR-90 hypothetical protein1
tcgcgttacagccttccagctccgccgaataacactcattataagattcctcccccggcttatcctagttctggggttgtcctattccttttgtttttccttatcactgccatcccagtggtactttacttgtgatacatcattatgtctatcctgtaggagaatttccgaaatcattcacaattggagaaactgcatatacactttttcatccatcgttgaagattacgatgtttcatcctcgtcggtttttctaagtaggagatactctcaattagatcatcatccactggtaagaatgcatatacactttcttgccttctgttggagatgaagggtttatcatcctcatgaaagtgacttttagagatgttcactggtatttgtattccgtggaagacactgattgtctttcctttctctggacaacccctagcactacttttaccggtgcggaggagttagaggttaattcgaggcgtttattattgtccgcaatgacgttaaactattaatgattcttatattaacgatttataatacttaatactgtaatacatttaacactacaaccgataactatcggtgatgggaattagagtcaacttcgatcttgaattgaagctctgttatctattccaatgccgctactctcccggcacgtaggagaaacacgggcgcatggctgcggctcggatcactattcactttggattttgatttaatacatgatttgctgttcccctgggtagttcccagtagcggagttggcaatgataacagccttagatggagcagggatgtagggaatatgttcgggtgaacctcaaaaggggaatctcatttaactaggttaaaatgacgtgtgggataacaacgtgcccactaaccattatagttatctaaataaccactatcccgtgcaattagcgcatgccctaaacgacgttttccatccgtgtatagagtggatcccttggattgagatctcaacaatctc

SEQ ID NO: 266 - DNA, 1000 bp, Shahe heteroptera virus 1
  strain SHWC13624 hypothetical protein1
agttccggagaaggagcactgtcggaacattatataataccacgcttcacgtggtcttgtataccggcattgtgaataccgtaaacctcttcaaggtacctcagtgtttgaattatttagctgaggataaattttcttaaatgagttgtcactgtacataatactcttcaagtagtacatacctcacgtaatttagaaaaggtgtttgaattctttaaccttttcaccttgaatttggcttaatcaatcatgtggatcttatgagcacggatcctgatgctgaaaagtgagcctagacgtggaggaacctgcaaggcgggtgttctttaaggctgtcgtaccctagctgagacagggggggtcccaatactgtcgaagccagacttttagaacatgtgccgctatcgaagggtagcacgcgggcgcgccctcctagagcgaagttcagccagtaagtatcgattgattaatcgacggtggacatgagcacccatcagtcaataaacaccccgttgggagagagaaacgaacgaggaatggcacacctcacaataaaaagccgttgtattctctttccggcctgggagtctcaaaccttcgaaccaattggttccgctacatatattggggacaattatgtggtgctacatccctcggacctaaggtagatcgtgtttatctacttgatagaacctcctgcacctcagagtgcggtccgtagtagaggcaagagaatagtatagcggtcagaaacaaactggattcttcaaaggtacgatttctcagactgagcagactgggtaaacctgctcctaaaaagcataaggggaaacccactgcaggcgtgaggcatttttcaaatgcctttttcgctaaatgggccatcgacccaactaagtccctcctagaggagctcctcggaacgcccgtaactgaggaggaattccggactttcgagcggggtttgtggaggcggccagtgattgtgccggcgcggtgt

SEQ ID NO: 267 - DNA, 1000 bp, Beihai picorna-like virus 53
  strain BHNXC41443 hypothetical protein1
cgggatcccgatcccggtgtagttttattctgttatgtggcgaacgataacggatgtataaactttgactcgatatcaaaatagactagatgcctatactcgataattgtcctaacggacattgtttcacccagaagtggtgttatgcagtgtcctattaggacctgcatagagatagtatgttgtaagctccaacctctttgtcttaacgcatattgtttatgaagttcatgctaaaactcaatacgcaaaagatgccttcctttgttgggctgtaaatacgatgaaggaccattcctctttaaaaagtcaaaacgacggtatattctgtacgtttgaataacccgtgtctcacggaaatgtgaggaatgttttctggtgtgacatttaaaaagcacaccagtgcaagatgttaatgatatattgagtggtgtatcatatacttgtatagcttaaagccttcacacgatggagtagaattcgtacgtgtgtcgtataattccagtacattccatattgagcgctccgctcttatggaagtgattagattaggagaactctctacgtggtacggtgcagtactttaaagcacttaatacacggagaactgtatgttcgtgtacgatcttactataggatagtaattgtctcgaaacaaacgacatttttgttgaagattagtatgtgcagattgctttagaatggcgctgccgattggaaaagaaatctgaattgaaacttttgtatgataatgccaaattaacttttggatggctctgcaactggaaaagatgtttagacgacaacttcggttagataatgtctaattacgatctgagaacactattattttggatgcattgtgttgcgcgtttctctgagcgctaccaaagtagtaattgaaacctccttttggagggtagtagagcacggatgtcgcaatgaataacaaaccaaaactttttggtttgagttcattgcgtcaagttctgttattaac

SEQ ID NO: 268 - DNA, 1000 bp, Beihai hermit crab virus 1
  strain BHJJX25619 hypothetical protein 11
aaagggcaacaacaatgtttatgcttatcacaaaagcaattaaggaacgtgtgttatagttcccactttatgtgacctaatgacggtgagcttccgtaagcaagtccgtacatactgaagaatactttgaaagaatctgcaacatggttctctctcgatagtatatatcaggtgacaaacacacactcaacccgattatttcgcgagttctcgataagagaccgcaccaggtcgagctggaggggtgtaccaatccccgcctaacgttgaacttataacgtctgttagtattgttgtaacaaaacaatcctagatgattttggatcctcaatgtatagattgatcacaagagtagtatggtattgattgaaattgaggctatatttaattcgaagattgtagagttcaatatgaaagcattccaagcaggggaccctgtgttagtacgttagaaattggaatcccccgttcagaggtttctgacaaataggatggttgacacatatgtgaatgttattcagttagagtagatttaattttggtacgtgagcagccaactcatgtacaaactgggtcagttaattggaaaacgcaaggagagttttcactgcaatgcagtctagctttagcaggaccaaaattaagttgtagaagactgaatatttacataggaggacgtacactgatggatttaactcgacctctgtgtcgagacggtgaggattaggaaagttccctactacttctcctaggacgccggtgcgactgtgtacgagtcgtacggaaagtgtgatctttagagagcacgaagtttaagtggggcctgacatggtaaagagtctgaaacagttcactgtaaaggtgaaccttggcaagctcgtgatcgatacgagattataaagcaagttcgatgtttccagatttcccttccccgcgccccaccccagaacactcacactttagtcttgtaaattttgaacaagactaaagattattgaaa

SEQ ID NO: 269 - DNA, 1000 bp, Beihai sipunculid worm virus 2
  strain BHNXC41483 hypothetical1
tttgttaccaaaatatttattcgtgtgttttatttgagcgattcgttagagtggctttcctagaacgccaccctatccggattcgtaaaacctcctagcaggtttcctcgaaccctgttagttatttgtttttacattgcatttattctcgttgatagagaactatcactttgctcgctccacagcgatacgtggatccccgcgcattacgcgcaagggaactttcacttgagtacggaaactttgtattcagatctattagattaattatgctacctatagcttgactataggtgttaaagtcccttcaagaaaactttagcagacgtgtgagactagaggacttcggtctagcgtctattagattctgtcatgaattggaaaagaactacttcttgtttttgattcccgaccccggttgtgttaagtaagatatcatctagcacccatgagtggttaaccccacatagatacagatattaaaattagccggcgaaagccttgagggtttgcacccctctctaagcctccatcaccgcttcatcgcggcgggggttactttttatttgcttctgaaagtctaacttttatttacgctctacttgaagagaaactagcgttcaaggcggtcgtcacccagactgtgactagcattgagagtgcgaatactctctcgtttattacttaccttgcttttgctttgcttattggctacattgttggcctatgggcttggcacgagagcattgtcccttcccaatctggtaaggctgagcgtaaagctcagtgggataaaaaacaaaagaacaagcgtaaggccgctgagaagcgtgccaaagcgcaacaagccaaagagaaacgtgaacttgagtctaagaagaaagtgactttcgagtcatctggacccaagtacgaatctcagtcaggcttttggtttggtgattccaaatggactaagtaccattggaccaaatttttcctgattggcacctacacgttc

SEQ ID NO: 270 - DNA, 1000 bp, Beihai picorna-like virus 42
  strain SCJXSX39263 hypothetical1
ctttataatatgtttttcgtgtatacgtcgtttagatgtgcgtcggcagcgattgtcccgtcgcatttataacatgacggtgtagatttactgcaatatttctacatgcggtgtgcaggaccctggagtagtgtatgttctcctttagacctgtgactacgtgagcgtgctaggttctcccttggaattacggttgcgtggttccttgggcgtgcttagccttgtccattggaggctgtacatatcctgttgagttgtggctctcattcaaaagccccggtgttgtgtgttgtttgctcacccggaagccttttgcagaaggcacgtcttcccacagacttgtaaatagtgggcggtgcttcctgtcgtaaccaggatccccctttccttgccttgagggtatcaaggcgaattgtgttgagatccccggatgggtctcctcactcttatgctaccatccaatcccttactgccgcgaggattatgtgcggtagactgggtcctactcctcgggtggggtagttcccttttatattaccacccaaacagttattttgatcttaactccttatttatatatccatttatgatttttatcaattgtgttaatggtttgccgcaattgagttttttgtattctagtggagttttgtgataaatggctgccatcgacggacgtcgatttgaacattaatgatatagtagtgaaaaatagaagtacattgatgttcttgtgtcggacagcaatatttgaccagtatgaaaaatattgtaaataacctttctttctgattggttctgtccggctgcgatacggtgagaaaacctgttccacagcgttgacatcgtctggtgttaagtttttgccatttgactgatagccatctcaattgagatgttgccctactaaactcttttggtcttaatacctggtgtcactgtgagttctgcgagtcaattctcacttacatccccggcccaaccctcctttccatcaaaa

SEQ ID NO: 271 - DNA, 1000 bp, Penicillium cairnsense negative-stranded RNA virus 1
  isolate1R
cgctcctcacctaccgctttcttgagagtttgttgagccttgttagccgcttcaagctcaggtcgtagttccgggaactcactcagaatccatttgttcttgatcaccgcctctttaattatgcgaagcgctcccatcccgaagtcggcgagaaggaggaacatattcatgaaagataaggcggatcccatccacggccgaccgatcatctgcaccactttgcttgtcatctgagaccggacaggctgatacgataaaaaagacgcgtagaccttcttcaagactgagtcagcaaggaatacagagtcggatacaaaaatctttggttcaccaatcactgaggcaagtgctgcaccttgacgtcgttcattgaacgcagaacgattcttgtcggtaactggtttattaccggctaggtaaagaagaccaaagtaggctccaagctcatcaacatccgtatccagaagagtaagaagctcctctgcagtgacgtcctctgcatcttcgaagttcgttttgagaacagattgttcttctgcctgactcagatcatctctaccaagacctgttatgtcgataggagtagcgcttgatccagtgaagttgaccctagcgttcagtaagattgctgtggcagatgcaagcgctctaatgatgaccgctttatctttactcttcaaaatttgaagcgcaaggaaggcaagagtctcatgacctcctccgtagaccacgttgatagtcacatcaattttcggcagatccggaatttcatatctaacgcgctgatcattcagttcgacagatgagtcgtcccacatactcaattgacccggagtgggtgggatgactttaggcaagtttccagtgttagcggaagacatagttgttcttaggattgaagtagatgaataagattatcgtttctcctagtttctttaaatgtacagaacgacctattctacaggatctgtaggtcctccgtgataagcatactaccaag

SEQ ID NO: 272 - DNA, 1000 bp, Changjiang astro-like virus
  strain CJLX30757 putative protease,1
acctgaatgtgccaaagaaatggtctgggcttaaatccattaaaccacatggatccccaaccactatcaagaaggggtatttgtggctggtgcgtgacgaccagccaaccctggttgcagtgaagttggggtggatgccaggcataattgcacatgatggatccactatccctggggatagtggcgcaccaatcactgatgagcatggcaacattttagccatacacaatgggtatttgcgtgacagtcaggttaatgccgcgttggcgcccccacaagtagttgttggtgggggtgttcaggacgaactggtcaatcttcgtgctacgaaccgtagaaatgaggagaagatgactgagatgttcgagcaaatgcggcagcttaagttgttgtgcgaaaagcatggtatcatgggtgaggttgaacaggaagcgcgtggtgcgagaaagcgaatggtcaatcatcagcggaagccattgcgcatatggagtgaccaagaatatgagaaattattggatgatggattcacacgagacgaacttaaggcgatagccacaaagcgccgtaaggaatatgattactatgaggatgttgagcctgagggttatgccaaagttcaggttaattcacgcgatgataaagttgacaacatgaaatccagttgtgtcagtgagacaacgactgaaaagcatgatcagaaacttgctaaagcgattacgaagtttgagcaagctgttgatggactcaagactgatgtgatagacgagacctaccctgacaaacaagttgaggtcgcgattgatctacacacggggcttgaccacaaacatgttagcgtgactaagacattgggcgatgcaggcaaacaggatttacgggaagccctggctaccattcagaactttatggttcagtggtcagctggggccaaccagcctcgagaggagatcgaactggaaacacggagagtaaaagagcactgccccctatatcaaatggg

SEQ ID NO: 273 - DNA, 1000 bp, Rhizoctonia solani ambivirus 1
  strain AG2-2 LP, complete genome.1R
cggcaggggatgtgagggacagacagtttcgtcaacttcgtgactactctatctcgtccggtcactgggtagtccacatgagatttgaaagaatctaagtgtacgcctttgatccactctctgccattcaaggtgaattgctccgcgtttccctctggagagcccttgcgctgatgacccaatctacggtgcctgcgttcccattatagcttatttgatatgtcgaccacaacgatcccccaatccgagattgatgcggctcttgtcgtactcgccgagtccccctctgagcgccaggaagtagcacccgaaatcgccgaacttgggcttaacgcgatccgtactgcaacaagcgatattgcctggaatggtgctccgctctggatccaacccaattacgccttgtatcgcgatcacatcgcacaattcatctatggagggaagaataaggttcctatcgtgttagcgggttcaacattctgtgatgttgcctatactggggagaaattgcccattcctcttccgattctcgtcattggctgggggaagacgcgcgttgccgaagaagttgcagaacagttcaggaattctggctttaaagattcgatgatccgctccgtcccggtccttgttaaggcgaatccaaccatcgaggacgctcgtcaggctattaatgccaaagcttcccttacctccccctgctctgccgagcatatgaacgtcttcgccttccgccagctaaacacgatcctaaacttggcctcttgtttcttgaagatccaccaatatcccgctttccttgacgaagatgccgtgtccgacttttgcatggctgattggcaacaggttgatcccgatgctgacaaacacaccactcatatggacgttgatgatgagaatgttcgagataagaagacttcaggctggaaggtacctagagattagtacaatggagtttccgaaccgtgctgacctttttgtaattcgctagggattgaag

SEQ ID NO: 274 - DNA, 1000 bp, Beihai weivirus-like virus 5
  strain BHZY60693 RNA-dependent RNA1
ttgcaagcatgcaattcgctctcctcttaattagaaggggtgctccggggaagacaacgccccggggtgagaaactcgtgtcccataattcaatccggtctgcctgccgccgcccgtgggacgtacctgtagaaggacccaggtattggacagtttgcagcgtggtttttactgagtggcgacgtcgaaaaatgaaaactaaaaatgctccctgcggtgtgtcgtcacctcggatggggcctgtcgtcacttgggggtcgcgcatcacttataagtgcgtggctttgttcgtttgctgcagtccggcgagtgccttattcttttgcctgtccggcctgtgacaggtggaagcctggtgtgcggggacgggacccgcctgaggtgaaggccggtgtggggggggagataggcaccctaagctcgccaagctgaaccccacacactacgagtcggcccggtccggggctgccccatctgcataggggttagtcaacagtggtcacgcgctggtaacggcgtgtggttgcaagccgaccttgtgaatggttgcggagccgagtcgcagcggtactgcgatgacagtcgtctgtggtgtggtgctctcgtgctgcccgtggaggaggtgaagaggtttgagccagccgcaagtagcttgccctcttaccggtggtgcggaaatttcccccttggggccgcccccgcggatgctgtcgcctttgtacataacaggtagcatgcgtatcccatacattacgtgtacgttaatatacccaccccgctggccggattcgtgcgagctgttggccgtagtgcccttgggccgtgcctggcttgtcgtcgcggattccgccagccacggggggctttacgtcgtctctgctaggagaggcggcgtctaaagggatccccttgagtcgaattcgtcagcttacctagccgtggcgtcgccaccgctagcgtgtgtttgcgcacggttcaccgtgcgtgtggtgttcgggtg

SEQ ID NO: 275 - DNA, 1000 bp, Dryglaski virus
  isolate Antarctic82 RNA-dependent RNA polymerase1
ttgccgatgttcaagcgtgggaacgctgggctaatgacccgactatcgatgccgcgcaaaaatggcgtgagcatcagccgtggtcgcggaagtcaggatcgcacacgtgcggtggatccaacgaggtttggtttgcaaccgaccatcgagacagagtcatgactttccttcgttatgattatactgtcacttccagcgcgacagtttggattaaagaacccagacctacgctttcgcgtagtatggggcttgacctccaaggtgtcatcccagccgcttgggatttgactgcgttttcctgggcggccgattggtttgggaattgctctcaagttatcaaggctgcaaattgccttttacttgggcccgagccaatgggtggatgggttacgactgtagttcgtggtaaagttaccgtgaagaaaagtccacacccacaagataaacagacagaagtccgtcaccatgagacctttaatgttaagtggaagaagcgtaggcccctagctttttgggaccgcttcccctcgttagagtataggcctaatctcgacccgtggagggtcgttgacatggcttctcttggtataatattctctaaagggcacaaagtgccaggagttatcaaacatggataagagtgcttacaagctctataccattggtcgggacgaggtagtttatgccacgcctgaccacacagtgtcaaattcagacactctcactatgcgacgtacgtcttccaaaaaacgtacagtcaagggaggtaatgttgaacttacgccacagcgcgtaaattacaactttaccaagactattgacgggaacttgatcacgctgtccgtcacaagtacaattgtacctgggactgatacagctcaggcgaagaccttctttagtgacgcgcttaccgcgttcgcagaggaatttgccggatctgcaatctccggtgacatcactcggactccctttaactaactttttataaggaacaattttt

SEQ ID NO: 276 - DNA, 1000 bp, Chronic bee paralysis virus
  isolate 3657 segment RNA1, partial1
tcatccgacatactccgggacgccaagaaccctgagccgccattctcatcctgcggcggtcgtggcgaggtctgtccctcccgtcatgatttccccggagccttgctctgtcactccgattactacctctacgacgagctctcttatgtcattcgtgggcacacttttatcatcaatcactcgtttcttgaagagaataagcacttccacaatgaagcgttcatcacgaagaaaggcgacggagtaatcatgtccacccctgacggcactgaatatcagcacccatacaacatctggaaagccgaaggttgtatcataggatccggtggtgctgccgtctatgcccgagtctatcgtgggccctcaatggatgtttactacgcctatcccgcttctggcacttatcatagtgatgatccacaccgcttaaaacgctcagaccaattcgagaatctccgccttagtagtggcaacattgccagactctctttcaaatccgtcaagattcaaaccacctccggtgacaccatcctcgattgccctcgcgatccctttgaaagagcagttgccaaatgcggtagcggtgtccgtgatctgaagttcttacccacgctatcttcatatatcatatccaaattaaccatgcacgatttagagattaataacgcacaagacatcttagaattagcaaacatcatgtgtgagcgcttcgcttttgacttctactcccactcccatcttgagtatgatcccaccaacataaacatcttcactaggtgtcgtcgtcatgctatgctgctggcccgcgctattcgccacaccctagcacgcaatataacatgttcgattattaatcgtcccatcttacggcaatttacaccttgggcatttaaaagcatcaccatgcctgcttacatcaagcaccgacgtgcacgtcacatcgacttaagacttgcgtctgacaggcctaagccctttcgtgacgggcgcccgatacttg

SEQ ID NO: 277 - DNA, 1000 bp, Carrot red leaf luteovirus associated RNA
  clone sigma RNA-dependent1
gggcacataccgttatgagaaaacggggggcagatgttccggcgatagtgacacatcgttaggcaacgtgagcatcatgctggcgattacgagggtggtttgtgagaggctaaaaggcatacacgtcgagatagcaaacgacggagacgatcaggtactgatggttgaggaaaaccacctcaacagcctggtcgaggagctcagccccacattcatgcggtttggtttccgcgtgaaagtagaggacccggtttgggaattcgagagaatagatttttgccaaaccagaccgatcttcctgtcacccaacgcgccaattatgtgccggtacccaatgcaatctatgtctaaagatgtagcgtcgttcctcaatatagaaagatctgagggatggaaatacatgctgcgagcgataggagcttgcgggtcttctagtttctcacaagtaccagtacttgggaagttctacagagcgttaagttccacatcaaacaagtcagaacacacatggtggaaacgcactggggtagatcttggattcaaacaactcacgaccaacgtgggcccggtccaatatgacgaaataacggcacgaagctccttctataaggctttcggcatactacctgacacccaaatggccctagagagggcaatagacgaatggtacataagccccacaccaccaattgagcacgtccataagttctcgagtgagtacccagtggttgaaggttgggcctaattgtagggtagcaataggtatagctagcctgcccccccccgcttgctgggccggtgggggcagcaccgcagacaacgtggttgagtttgggaacatagatccgaacaccacgtcacgggtaggccacacccgcggagtcaggctgattgccataattggcaggtggggccacgccgtttggccaaaccacccgggtcaccggtagggagaggtctctagggatccgagtgctgccctgttgtaggggcacgctca

SEQ ID NO: 278 - DNA, 1000 bp, Carrot red leaf luteovirus associated RNA
  clone a25 putative RNA1
tacacattgaagtagccaatgatggagatgaccaggtgttgatggtcgagacaaaccaactcgacaacctggtcaaggagcttagtcccacattcgcgcgatttggttttcgcgtgaaagtagaggatcctgtctgggaattcgagagaatagatttttgccaaaccagaccgatcttcctatcaccaggtgagcccataatgtgccgatacccaatgcagtctatgtccaaagacgttgcgtccttcctcaatatagaaagatcagagggatggaaatacatgctcagagctataggagcatgtgggtcttctagtttctctcaagttccagtgcttggtgagttttatagtgcgctcagctccacatcaaacaaagatgaaaccaaatggtggaggcgcacgggagttgatttggggtttaaacagcttaccaacaatgtaggcacgatcccttacgacgaggtcacggcacgaagctccttctataaggccttcggaatcctcccagacacccaagcagcactcgaaagcaaaatacgcaactggaatatgagctccgtaccacacatcgagcaagtccacaaattctcgagtgagtttcccgtggttgacggatgggcctaacttagggaatacagttaggttaagttagtcggcccctcctcttgctggctgggtgagagggggggccagcgcagactggttggataggtttgggaacatagatccgaactccaatcaacgggtaggtcgcacccgcgtagtcgagaatgattaccataattggtaggtgaggtcacgccgtatggccaagtcacccgagctttcggtagggggtctagttgttgagtgccattatgacataaccaactagacaccccacatttggagaagcggcttgcccacgctccaacattccatggatagattgaacgacgaaatgtcattgtcttgccgtcagaggcgttcccctctccaaggctagcccgacgtgcgcc

SEQ ID NO: 279 - DNA, 300 bp, Bovine viral diarrhea virus 1
  clone SWU-Z6, complete genome.1
gcgaaggccgaaaagaggctagccatgcccttagtaggactagcataaagaggggggtagcaacagtggtgagttcgttggatggcttaagccctagtacagggtagtcgtcagtggttcgacgccttggcataaaggtctcgagatgccacgtggacgagggcacgcccaaagcacatcttaacctgagcgggggtcgctcaggcgaaaacagtttgatcaactgctacgaatacagcataataggttaggccagaggcccactgttctgctactaaaaatctctgctgtacatggcac

SEQ ID NO: 280 - DNA, 301 bp, Sicinivirus sp.
  strain RS/BR/2015/2S-1 polyprotein gene, partial1
tgtggtgattagtagaccccctggaggtacccgttttggatctgaccagggacccgtgactataccgttccggtaattcgggtttaaaacaatgaacgtcaccacacactttctttttccctttattttatttgtttgttcagtatgttttatgagttgctcattattgctgcccttgtcgtgattcttgtttcaccgcatgatacccagtgtcttattgtcgtctgtttggtcaattttcttgtatactttctttggacaattccagggttagaccttccattatacccagcaatacaac

SEQ ID NO: 281 - DNA, 303 bp, Feline picornavirus
  strain 661F, complete genome.1
tggccaccggggaaaaacggctactgtgcaccacctctgcaccccacgccgaccacgcctaaccatggcgttagtaggagtggaggaccactgcagagggtcctggtgtgcgacagtcagtggtagagtagacagtcctgactgggcaatgggaccgcgttgcgtatccctaggtggcattgagatttctctgccacccaccagcatggattcctgtggggggggccccatgggctaggtctatactgcctgatagggtcgcggctggtcgactgctgactgtataaccagttgtaacttact

SEQ ID NO: 282 - DNA, 304 bp, Swine vesicular disease virus
  isolate ITL/16/2006, partial genome.1
tagttggtagtcctccggcccctgaatgcggctaatcccaactgtggagcagatacccacgcaccagtgggcagtctgtcgtaatgggcaactctacagcggaaccgactactttgggtgtccgtgtttcttttatttattcctacgctggctacttatggtgacaattgagagactgtagttatattgccatcagattggtcatccggtggagaataaaacagttgctcacctgtttgtcagtcctgcaccgtcgtgccatagagtcttaactgcccctcaacatcgtcgtaaacacgctgga

SEQ ID NO: 283 - DNA, 305 bp, Bat picornavirus 1
  strain LMH22A, complete genome.1
gtggctggccaccacggaataacggcaattgtttgtatgtgggaggtcaagcctgcctagccgataacctttgaccgggtgtgtaggatagaacaggaacccactacaggcgacaggttatggtagagtggatacctagccaggggcaatgggactgcgttgcatatccctaatgagccatcgagatttctctggccattacccggtgatggttgtgtggggggggccccacacactagatccatactgcctgatagggtcgcggctggccgaccataacctgtatagtcagttgactttgaatc

SEQ ID NO: 284 - DNA, 306 bp, Coxsackievirus B5
  isolate 028/Pakistan/91, partial genome.1
taactggtagtcctccggcccctgaatgcggctaatcctaactgcggagcagatacccacatgccagtgggcagtctgtcgtaacgggcaactctgcagcggaaccgactactttgggtgtccgtgtttccttttattcttatactggctgcttatggtgacagttgaaagattgttaccatatagctattggattggccatccggtgacgaacagagcaattatttacctatttgttggttttgtaccattaaatcacaaagttttaaaaacattgaaccttgttttagcatttaatacagcaaa

SEQ ID NO: 285 - DNA, 306 bp, Swine vesicular disease virus
  isolate TAW/119/97, partial genome.1
tagtcggtagtcctccggcccctgaatgcggctaatcctaactgtggagcagatacccacgcaccagtgggcagtctgtcgtaatgggcaactccgcagcggaaccgactactttgggtgtccgtgtttcatttgttcctacactgactatttatggtgacaattgagagactgtaactatactactatcagattgaccacctggtataaaataaaacagttgttcacctgtttatcagcctcgcaccgttgtactgtaaagcctcagacaccccccaacactatcataacacgtagatcattaaa

SEQ ID NO: 286 - DNA, 306 bp, Unknown
  Description of Unknown: Human coxsackievirus B4isolate CB4_Cph1 polyprotein gene, complete1 sequence
tagttggtgatcctccggcccctgaatgcggctaatcctaactgcggagcacatgctcacaaaccagtgggtggtgtgtcgtaacgggcaactctgcagcggaaccgactactttgggtgtccgtgtttctttttattcctatactggctgcttatggtgacaattgagagattgttgccatatagctattggattggccatccggtgtcgaacagagcgatcatttatctgtttgttgggtttgtacccttaaatcttagagttttcaaaactctcaacctcgtactacaactaaactcagcaaa

SEQ ID NO: 287 - DNA, 306 bp, Unknown
  Description of Unknown: Human coxsackievirus B4, isolate CB4_Cph2 polyprotein gene, complete1 sequence
tggttggtagtcctccggcccctgaatgcggctaatcctaactgcggagcacatgcccacaaaccagtgggtggtgtgtcgtaacgggcaactctgcagcggaaccgactactttgggtgtccgtgtttctctttatccctatactggctgcttatggtgacaattgagagattgttgccatatagctattggattggccatccggtgtcaaatagagcgattatctacctatttgttggatttatacctttgaattttgaagtatttaagaccctcaaccttatattacaactcaattcggtaaa

SEQ ID NO: 288 - DNA, 306 bp, Unknown
  Description of Unknown: Human coxsackievirus B4isolate CB4_Cph10 polyprotein gene,1 sequence
tagttagtagtcctccggcccctgaatgcggctaatcctaactgcggagcacatgcccacaaaccagtgggtggtgtgtcgtaacgggtaactctgcagcggaaccgactactttgggtgtccgtgtttctctttattccaatactggctgcatatggtgacaattgagagattgttgccatatagctattggattggccatccggtgtcgaacagagcgatcatctacctatttgttggatttgtgcctttgaattttgaagtattcaagactctcaaccttgtactacaactcaattcggcaaa

SEQ ID NO: 289 - DNA, 307 bp, Swine vesicular disease virus
  isolate HKN/4/89, partial genome.1
taattggtagtcctccggcccctgaatgcggctaatcctaactgcggagcagatacccacgcaccagtgggcagtctgtcgtaatgggcaactctgcagcggaaccgactactttgggtgtccgtgtttccttccgttcttatattggctgcttatggtgacaattggaagattgttaccatatcgctattggattggccatccggtgacgattagaacacttgtatacctatttgttagctttgcaccgctgaactacagagccttaagcaccctttgatcacattacaacacccaacacgtcaaa

SEQ ID NO: 290 - DNA, 307 bp, Swine vesicular disease virus
  isolate HKN-8-73 polyprotein gene,1
taattggtagtcctccggcccctgaatgcggctaatcctaactgcggagcagatacccacgcaccagtgggcagtctgtcgtaatgggcaactctgcagcggaaccgactactttgggtgtccgtgtttccttttattcttatactggctgcttatggtgacaattgagagattgttaccatattgctattggattgtccacccggtgacaaatagaacagttgcttacctgattattagtttcgcaccactgaactacaaaaccttaaacaccctttaatttcatcacaacgcacaatacgttaaa

SEQ ID NO: 291 - DNA, 307 bp, Swine vesicular disease virus
  isolate HKN/7/81, partial genome.1
tagttggtagtcctccggcccctgaatgcggctaatcctaactgcggagcagatacccacgcaccagtgggcagtctgtcgtaatgggcaactctgcagcggaaccgactactttgggtgtccgtgtttccttttactctcatactggctacttatggttacaattgagagattgtgaccatattgctattggattggccatccagcgacgaatagaatagttgcttacctgtttgttaacctcgtatcactgaactacaaagccttgaataccctttaacttcatcataacgctcagtacgctaaa

SEQ ID NO: 292 - DNA, 307 bp, Swine vesicular disease virus
  isolate FRA/1/73, partial genome.1
tagttggtagtcctccggcccctgaatgcggctaatcctaactgcggagcagatacccacgcaccagtgggcagtctgtcgtaacgggcaactctgcagcggaaccgactactttgggtgtccgtgtttccttttattcttatactggctgcttatggtgacaattgaaagattgttaccatattgctattggtttggccacccggtgacgaatagaacagttgtttacctaattgttagtttcgtaccactgaactacaaagccttaaacaccctttaatttcatcataacactcaacacgttgaa

SEQ ID NO: 293 - DNA, 308 bp, Swine vesicular disease virus
  isolate HKN/19/70, partial genome.1
taattggtagtcctccggcccctgaatgcggctaatcctaactgcggagcagatacccacgcaccagtgggcagtctgtcgtaatgggcaactctgcagtggaaccgactactttgggtgtccgtgtttccttttgttcttatactggctgcttatggtgacaattgagagattgttaccatattgctattggattggccatccggtgacgaatagaacaattgtttaactatttgttggttttgtaccgctgaaccacaaagccttaaacaccctttaatttcatcataacgctcaatacgttagaa

SEQ ID NO: 294 - DNA, 308 bp, Swine vesicular disease virus
  isolate ITL/5/77, partial genome.1
tagttggtagtcctccggcccctgaatgcggctaatcctaactgcggagcagatacccacgcaccagtgggcagtctgtcgtaatgggcaactctgcagcggaaccgactactttgggtgtccgtgtttccttttgttcttatactagccacttatggtgacaattgagagattgtaaccatattgctattggattggccacccggcgacgaatagaacagttacttacctgtttgctatcctcgtatcgccgaactacaaatccttaaacaccctttaatttcgtcacaacgctcaatacgttaaaa

SEQ ID NO: 295 - DNA, 308 bp, Swine vesicular disease virus
  isolate HKN/3/91, partial genome.1
tagttggtagtcctccggcccctgaatgcggctaatcctaactgtggagcagatacccacgcaccagtgggcagtctgtcgtaatgggcaactccgcagcggaaccgactactttgggtgtccgtgtttcttttttgttcctacactggctacttatggtgacaattgagagactgtaaccatattgctaacggattggccacctggtatagaatagaacaattgcttacctgtctggcagtctcacaccgttgtaccataaagcctctgacacccctcaacaccgtcataacacttaacacgttgaa

SEQ ID NO: 296 - DNA, 308 bp, Human rhinovirus B
  strain HRV-B06_p1159_sR2067_2009 polyprotein1
gctgtgaccataagacaataatgagtaaaaagagaaacacggacacccaaagtagtcggtcccgtcccggaattgctcattacgaccttaatatcactggtttgtaatacaaggctccagggttaaggttagccgcattcaggggccggaggaatcacaaccaagcacatgcgagtcttcacaccatgtctataaaagggcgtaatgagcaattccgggacgggaccgactactttgggtgtccgtgtttctctttttactcattattgtcttatggtcacagcatatttgttaaatatactgtgatc

SEQ ID NO: 297 - DNA, 310 bp, Bovine viral diarrhea virus 2
  strain AU501 structural polyprotein1
gcagccccggacatctaagggcatggctagccatgcccttagtaggactagcaaaaggaggggactagcagtagcagtgagttcattggatggccgaatccctgagtacagggaagtcgtcaatggttcgacactccattaaccgaggagtctcgagatgccatgtggacgagggcatgcccacggcacttcttaacctatgcgggggttgcatgggtgaaagcaccattcgtggtgttatggacacagcctgatagggtgtagcagagacctgctattctgctagtaaaaactctgctgtacatggcac

SEQ ID NO: 298 - DNA, 310 bp, Human rhinovirus B
  strain HRV-B06_p1220_sR1439_2009 polyprotein1
atgctgtgaccataagacaataataagtaaaataagaaacacggacacccaaagtagtcggtcccgtcccggaattgctcattacgcccttttatagacatggtgtgaagactcgcatgtgcttggttgtgattcctccggcccctgaatgcggctaaccttaaccctggagccttgtattacaaaccagtaatattaaggtcgtaatgagcaattccgggacgggaccgactactttgggtgtccgtgtttcttattttacttattattgtcttatggtcacagcatatttgttaaatatactgtgatc

SEQ ID NO: 299 - DNA, 315 bp, Fur seal picorna-like virus
  isolate KGI-Bel-22, complete genome.1
ttctgcttgctctacgtgcggcgcacgttaaaacgtcccggtggtgtctgtgagcatcatcgttactcttaggagaaacaattatcacaacatgttagtgcggcgcacttcaaacgtcccggggacattcgtgaatgtcatcgtaactccatggagaaatcaaaatcacgatagaagtactgattacggcagcctacaaaggcttgaagtttaccatgtacctgacgcttgcttctatttggacttacaactcttcagttgtgcggcaaccaccgcagaaaaacttagacagggtcctaccatgatgttggtagg

SEQ ID NO: 300 - DNA, 315 bp, Human cosavirus E/D
  strain NG385 polyprotein gene, complete cds.1
ctacaagctttgtgtaaacaaacttttgtttggcttttctcaagcttctctcacatcaggccccaaagatgtcctgaaggtaccccgtgtatctgaggatgagcaccatcgactacccggacctgcaaaattttgcaaacgcatgtggtatcccagccccctcctctcggggagggggctttgctcactcagcacaggatctgatcaggagatccacctccggtgctttacaccggggcgtggatttaaaaattgcccaaggcctggcgcacaacctaggggactaggttttccttatattttaaagctgtcaat

SEQ ID NO: 301 - DNA, 316 bp, Feline picornavirus
  strain 127F, complete genome.1
gatgtcggatgacggctggccaccggggaaaaacggcaaatgtgcaccacctctgcaacccacgccgaccacgtttaaccatggcgttagtaggagtggaccactgcagtgggctctggtgtgcgacagtcagtggtagagtagacagtcctgactgggcaatgggaccgcgttgcgtatccctaggtggcatcgagattcctctgctacccaccagcgtggactcctatggggggggccccataggctaggtctatactgcctgatagggtcgcggctggtcgaccactgactgtataaccagttgtaactcact

SEQ ID NO: 302 - DNA, 317 bp, Antarctic picorna-like virus 2
  nonstructural protein and structural2
atcctcggctccgtcccggaaagacttaaaacttgtccctctgagcgcactagcgtgctcactaaaccaaagacagtattctgccatggataccataccggacacacactctttattgtcccaaaaggcttggcattgtaggcttgaaggctatttagccttggattcaccatccaagagaaccccacgtgcgtagcttgagtcagctagcacatagtggtccccgacttacttcaaaacttacaacaatcagctctgctcctaacgatcataaggagtatagcgtgaaatttcatgatcaaacccctgactgggtt

SEQ ID NO: 303 - DNA, 318 bp, Bovine viral diarrhea virus 1
  genome assembly, complete genome:1
ggaacaaatcctcctcagcgaaggccgaagagaggctaaccatgcccttagtaggactagcatatagaggggggtagcaacagtggtgagttcgttggatggctgaagccctgagtacagggtagtcgtcagtggttcgacgctccagaatgcgagcctcgagatgccacgtggacgagggcatgcccacagcacatcttaacctaggcaggggtcgcctaggtgaaagcgggtggaccaaccgttacggacacagcctgatagggtgctgcagaggcccactggactgctactaaaaatctctgctgtacatggcac

SEQ ID NO: 304 - DNA, 319 bp, Parechovirus-like virus PLV-CHN
  complete genome.1
acatggggtatgttgtctgtcctgttttgttgaaacaatatataagatcctttccgccgatatagacctcgacagtctagtgtaggaggattggtgatagtaacttgccccagaagagtgaccgtgacacatagaaaccatgagtacatgtgtatccgtggaggatcgcccgggactggattccatatcccattgccatcccaacaaacggagggtatacccactatgtgcgcgtttgcagtgggagcctgcaaatttagtcatactgcctgatagggtgtgggcctgcactctggggtactcaggctgtttatataat

SEQ ID NO: 305 - DNA, 319 bp, Enterovirus sp.
  isolate PoEV_VIRES_YN01_C1 polyprotein gene,1
gaatgcggctaatcctaaccacggagcacccaccagtaaaccagctgggagggtgtcgtaacgggtaactctgtggcggaaccgactactttgggtgtccgtgtttccttttgatcctattttggctgcttatggtgacaacgataagttgttatcataaagcttttgggttggccacctggaaaaagttatcagtgtttgatattgctcggctttcacgcctaccaataaaacaagctttatattacttaatttccttttacccaaaggaagaaatctctgaatttcatcttcaactgctcttaacattatcagcaag

SEQ ID NO: 306 - DNA, 321 bp, Echovirus E6
  isolate ETH_P17/E6_2016 polyprotein gene, partial cds.1
agagtctattgagctaattggtagtcctccggcccctgaatgcggctaatcctaactgcggagcagatacccacacaccagtgggcagtctgtcgtaacgggcaactctgcagcggaaccgactactttgggtgtccgtgtttccttttattttttacactggctgcttatggtgacaattgagaaattgttaccatatagctattggattggccatctggtgacaaacagagcgattatttacctatttgttggttttgtaccattgaattttaaagtattaaaaacccttaacctcattctaacatttaacacagtaac

SEQ ID NO: 307 - DNA, 322 bp, Human rhinovirus A
  strain HRV-A34_p1058_sR263_2008 polyprotein1
agagagttatgtatggacatgtccagtcaggtctaggggtcctgctggcgacagtgttctagcctgcgtggctgcctgcgtgtcctcacgggcacgaagccatttacttgacaaggtgtgaagagtcccgtgtgctcgtcttgagtcctccggcccctgaatgtggctaaccttaaccctgcagccagtacacacaaaccagtgtgtagctggtcgtaatgagcaattgcgggatgggaccaactactttgggtgtccgtgtttcactttttaccttttattatgcttatggtgacaatatatagacatatatattgacacc

SEQ ID NO: 308 - DNA, 323 bp, Bat pegivirus
  isolate PDB-99 polyprotein gene, complete cds.1
ggtgcgcgtgaaaccttctcgtcacagaagattagcgcgctaggtacgccaaaggcgtaggcccccggcggtttgcaccgacgtgggacaatgcgctggaggattttacagccgacagagctgcaaaacctgtagtaaggccggagtaccggcctcccagcccgcgtcagcctaaacctggctgtcatacgcggtgtatggaggacatgtccaactatgggtgccttggggtggttccccttggcgtggtgtgacgaccatagcagtactgcctgatagggtcccggcggatgggtcggctgtgtacatccgttgtccccccc

SEQ ID NO: 309 - DNA, 323 bp, Feline picornavirus
  strain 356F, complete genome.1
ggaatgtggatgacggatgacggttggccaccggggaaaaacggcaattgtgcacctcctctacaacctacgccgaccatgcctaaccatggcatcagtaggagtgggcccctgtagtgggtcaaggtgtgcgacagtcagtggtagagtagacaatcctgaccgggcaataggactgcattgcatatccttaggcggcattgagaagcctctgccacccaccggcatggatttctatggggggggccccatagactaggtctatactgcctgatagggtcgcggctggtcgaccactgactgtataaccagttgtgtataac

SEQ ID NO: 310 - DNA, 324 bp, Enterovirus C
  strain 04-4517, complete genome.1
agcctactgagctacttgagagtcctccggcccctgaatgcggctaatcccaaccacggagcaggtgaccataaaccaatggttggcctgtcgtaatgcgcaagtctgtggcggaaccgactactttgggtgtccgtgtttccttttacctttttcattggctgcttatggtgacaatcatagattgttatcataaagcgaattggattggccatccggtgaaaatcagagcgattgtatacttgtttattggattcactccattaacaccaaactccctaacactcatcaaactagttttgttgataagacactactatcata

SEQ ID NO: 311 - DNA, 327 bp, Enterovirus B73
  isolate TO-127, complete genome.1
ggtgtgaagagtatattgagctagctggtagtcctccggcccctgaatgcggctaatcctaactgcggggcaagcacccacaatccagtgggcagcttgtcgtaacgggtaaccctgcagcggaaccgactactttgggtgtccgtgtttcctttatttttaaaactggctgcttatggtgacaattgagagattgttaccatatagctattggattggccatccagtcaccaacagagcaattgtgtacctctttgtagggttcataccacttaattttactagctacaacacactgtgtttcattatcgatttaaacacagcaag

SEQ ID NO: 312 - DNA, 328 bp, Enterovirus G
  EV-G/Wild boar/JPN/Ishi-16/2019 gene for polyprotein,1
ccggcccctgaatgtggctaatcccaaccacggagcgctcgccaacaaaccagttggtagggcgtcgtaacgggtaactctgtggcggaaccgactactttgggtgtccgtgtttccttttgatcctatattggctgcttatggtgacaacgataagttgttatcataaagcttttgggttggccacctggaaaaagttatcagtgtttgatattgttcggctctcgcgcctaccagtaaaacaagcattatactatttaatttccttttatccaaaggaagagatttctgagtttcatttacagttgctcttagtgttgtcaacaag

SEQ ID NO: 313 - DNA, 329 bp, Human hepegivirus
  isolate AK-790 polyprotein gene, complete cds.1
tgaactgttgttgtagcaatgcgcatattgctacttcggtacgcctaattggtaggcgcccggccgaccggccccgcaagggcctagtaggacgtgtgacaatgccatgagggatcatgacactggggtgagcggaggcagcaccgaagtcgggtgaactcgactcccagtgcgaccacctggcttggtcgttcatggagggcatgcccacgggaacgctgatcgtgcaaagggatgggtccctgcactggtgccatgcgcggcaccactccgtacagcctgatagggtggcggcgggcccccccagtgtgacgtccgtggagcgcaac

SEQ ID NO: 314 - DNA, 329 bp, Porcine teschovirus
  isolate SH1, complete genome.1
ttcccaccctcaccctctggatttgtaactgataagtgatgatccttggaagctaggtactcgttacgctggttttggattgtcttgtgcccaacactagttttcggactcttgttgtgtttaaacacagaaatctgattatttggttgtagatttactggacccaccctttgaaagacctgctctggcgcgagctaaagcgcaattgtcaccgggtattgcaccaatggtggcgacagggtacagaagagcaagtactcctgactgggtaatgggactgcgttgcatatccctaggcacctattgagatttctctggggcccaccagc

SEQ ID NO: 315 - DNA, 331 bp, Porcine teschovirus 2
  strain T80 polyprotein gene, complete cds.1
actagtccttggacttttgttgtgtttaaacacagaaatttaattacctggccatgaattcattggattaacccttctgaaagacttgctctggcgcgagctaaagcgcaattgtcaccaggtattgcaccagtggtggcgacagggtacagaagagcaagtactcctgaccgggcaatgggactgcattgcatatccctaggcacctattgagatttctctggggcccaccggcgtggagttcctgtatgggaatgcaggactggacttgtgctgcctgacagggtcgcggctggccgtctgtactttgtatagtcagttgaaactcacc

SEQ ID NO: 316 - DNA, 331 bp, Teschovirus A
  isolate R6 polyprotein gene, complete cds.1
actagacctcggtcttctgttgtgtttaaacacagaaatcttgctatctgactatgaattcataggactaacccctctgaaagacttgctctggcgcgagcaaaagcgcaattgtcaccaggtattgcaccaatggtggcgacagggtacagaagagcaagtactcctgactgggcaatgggactgcgttgcatatccctaggcacctattgagatttctctggggcccaccagcgtggagttcctgtatgggaatgcaggactggacttgtgctgcctgacagggtcgcggctggccgtctgtactttgtatagtcagttgaaactcatc

SEQ ID NO: 317 - DNA, 332 bp, Porcine teschovirus 2
  strain Vir 480/87 polyprotein gene, complete1
actagaccttggtctcttgttgtgtttaaacacagaaatttttcctatttggttatgaattcattggatcaatccctctgagagacctgctctggcgcgagcaaaagcgcaattgtcaccaagtactgcactaatggtggcgacagggtacagaagagcaagtactcctgactgggcaatgggactgcgttgcatatccctaggtacctattgagatttctctggggcccaccagcgtggagttcctgtatgggaatgcaggactggacttgtgctgcctgacagggtcgcggctggccgtctgtactttgtatagtcagttgaaactcact

SEQ ID NO: 318 - DNA, 333 bp, Bovine viral diarrhea virus 1
  isolate CA2006, complete genome.1
caatgattaggcctagggaatgaatcccccttagcgaaggccgaaaagaggctagccatgcccttagtaggactagcataatgaggggggtagcaacagtggtgagtttgctggatggcttaagccctgagtacagggtagtcgtcagtggttcgacgcctcagtgaggaggtctcgatatgccacgtggacgagggcatgcccaaagcgcatcttaacctgggcgggggtcgctcaggcgaaagcggtttattaactgctgcaaatacagcctgatagggtgctgcagaggcccactgtattgctactaaaaatctctgctgtacatggcac

SEQ ID NO: 319 - DNA, 333 bp, Atypical porcine pestivirus
  isolate KU16-5 polyprotein gene,1
tgctgtgagccccgtggtgagtgggggaaaggggttaaccaggcctctagtaccacaggcaccattggacagggcaactcgaacctgagagagaggtaccgaacccttaagccccgagtacggggtagacgtcaccgagtagtacacccaaagaccaccacattcaggtgtagggtctactgaagctcgggtggacgtgggcgtgcccaaagggaaatcggtggtggacctgggggttgggcccgccatgccccttcatggggtagacctcactgcttgatagagtgccggcggatgcctcaggtaagagtataaaatccgttgttcattaac

SEQ ID NO: 320 - DNA, 335 bp, Porcine teschovirus 1
  strain Teschen-Konratice polyprotein gene,1
caacactagacctcggtctactgttgtgtttaaacacagaaatctcgctacttggttatgaattcattggatcaatccctttgaaagacctgctctggcgcgagcaaaagcgcaattgtcaccaggtattgcaccaatggtggcgacagggtacagaagagcaagtactcctgactgggcaatgggactgcattgcatatccctaggcacctattgagatttctctggggcccaccagcgtggagttcctgtatgggaatacaggactggacttgtgctgcctgacagggtcgcggctggccgtctgtactttgtatagtcagttgaagcacact

SEQ ID NO: 321 - DNA, 337 bp, Bat picornavirus
  isolate BtNv-PicoV/SC2013 polyprotein gene,1
accttttccccctctaaggcaatgcactttggtttattctcatggatcatgattttagaggctggccacctaggttaaacggcaattattagtgataggggtcaaacactcatcgtgaaaccgtccagtagcgaggagtagttccctatctactagtgactagtgtgagcagagtaggaggtatacaaggaagtgggacgctatttgctatccccgtattgagagttctctacaccttgtgtatacagtggattgggaagtccactctggtcctatactgcctgatagggttgttaactgtcagctcacacttagtataacagtttgtcaaacactt

SEQ ID NO: 322 - DNA, 337 bp, Enterovirus C
  isolate mew716_CV-A polyprotein gene, complete cds.1
tacccatggctaacgccatgggacgctagttgtgaacaaggtgtgaagagcctattgagctacttaagagtcctccggcccctgaatgcggctaatcctaaccacggagcaagtgcccacaaaccagtgggtagcttgtcgtaacgcgtaagtctgtggcggaaccgactactttgggtgtccgtgtttccttttatttttatcatggctgcttatggtgacaatctaagattgttatcatatagctgttggattggccatccggtgatttacagagacttgagaactaacccgcctttctacaacactcatttacttattaatctcacaatacaaa

SEQ ID NO: 323 - DNA, 338 bp, Phacovirus sp.
  strain RS/BR/2015/1R-1 polyprotein gene, partial1
ctcgtgagtagtacttggccctgcccattacttgaggaccgactcttcttgactacaatgtgtttaaagtaacctggaccacattgtgtatccagacaactccattaggtaatgtacgctggagacgttttcagtgcatagggttctaaagtggtgctgaaatattgcaagctcaatggaatactgaacgctgaaaaccgccgctattatcttttgggccccttgtgggcaaacgttggctttaagcatatactgcttgggaatgcagtactggttgtagacagggtgatagcctaccggctggcgtagttgagttggtatagccagttgattgccat

SEQ ID NO: 324 - DNA, 341 bp, Hepatitis C virus
  replicon I389/NS2-3'UTR.1
gccagcccccgattgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcacc

SEQ ID NO: 325 - DNA, 343 bp, Culex theileri flavivirus
  complete genome.1
atataaatcccagtttggttaaacctatttcaaggcttaagttgtttattattttatcgccgctcgtgactataaagttgcctagcggagagagataaagaagaaggagttcaaggctcagggcagggcgcaagttccctggtccctaggccgctcgcaggaaggaggagtgaagaagaagaaagagaaggagaggaccaccgccgaaagaaggcaggtgcctcacaagagggccaaccagcgtgttggaccagtggccaacgccggacggcgtggtggcctgctgggacgcctggggattggatggagtgccttcctacaggaagacatcgttcaagccatc

SEQ ID NO: 326 - DNA, 343 bp, Parechovirus sp.
  QAPp32 polyprotein gene, complete cds.1
acatggggcaggtgtgctgtgccaagagcaacactacggtggccgagccgatggttcgtcaccacgtagtaggactccgtagtgcttggttacggcggacgtaagtcagttgagtgatgtctaagtggcaaaccatgagtacatggtaaccttgtgtggactcgcgggacggaatttcctatcccattgactccttgtagcaaggtgggtatacccaaccacaatggcagcaccctgggtgggaacccaggggcctggattagtatccagtcacacagcctgatagggtggcggctcagccactgaccagcgtctctaaataattgtgagctgttcatgcacc

SEQ ID NO: 327 - DNA, 343 bp, Porcine teschovirus 2
  isolate Stendal 2532 polyprotein gene,1
cttgtgcccaacaaaaggctttggtctcttgttgtgtttaaacacagaaattttgttactcggttatgaattcactggattaacccctttgaaagacctgctctggcgcgagctaaagcgcaattgtcaccgggtattgcaccaatggtggcgacagggtacagaagagcaagtactcctgactgggcaatgggactgcattgcatatccctaggcacctattgagatttctctggggcccaccagcgtggagttcctgtatgggaatgcaggactggacttgtgctgcctgacagggtcgcggctggccgtctgtgctttgtatagtcagttgaaattcact

SEQ ID NO: 328 - DNA, 343 bp, Porcine teschovirus 2
  isolate DS 183/93 polyprotein gene, partial1
cttgtgcccaacattggtcctcggacttctgttgtgtttaaacacagaaattcaactattcggttatgaattcattggatcaaccctcttgaaagacctgctctggcgcgagctaaagcgcaattgtcaccaggtattgcaccatcggtggcgacagggtacagaagagcaagtactcctgactgggcaatgggactgcattgcatatccctaggtacctattgagatttctctggggcccaccagcatggagttcctgtatgggaatgcaggactggacttgtgctgcctgacagggtcgcggctggccgtctgtactttgtatagtcagttgaaatgcact

SEQ ID NO: 329 - DNA, 347 bp, Bovine viral diarrhea virus 1
  viral cRNA for polyprotein, strain1
aattccaaaacagaaatcaggcctagggaacaaaatcctcctcagcgaaggccgaaaagaggctaaccatgcccttagtaggactagcaaattggggggggtagcaacagtggtgagttcattggatggccgaagccctgagtacggggtagtcgtcagtggttcgacgccttaaggaaactaggtctcgagatgccacgtggacgagggcatgcccacggcatatcttaacctgcgcgggggtcgctcaggtgaaagcggcataaatgaccgttatggacacagcctgatagggtgctgcagaggcccactgtattgctactgaaaatctctgctgtacatggcac

SEQ ID NO: 330 - DNA, 347 bp, Picornaviridae sp.
  isolate ybb150shi01 genomic sequence.2
atgtttgtttcatcatatcactatttttgtatcctatcttgattaatcgcttagattggcttggggaagccgatgcgaatttccgccacctcacccccctcaattgtccaaatcagggactgggaaggttttaactaagggcataatttgtcagtggatggtctaggtacagagaatggcgcggtcacttcttctcagtgaacaccgtttgtcctaccctcttaggcccgccatctgctgaatttctgttgcagctggtagtcgcttttgtaattaatcactatagaaatacaatccactttcgtcttctttttgtatccccttctctatagattcgtgtgttttac

SEQ ID NO: 331 - DNA, 348 bp, Bovine viral diarrhea virus 1
  genome assembly, complete genome:1
cgaaccactgacgactaccctgtactcagggcttcagccatccaacgaactcaccactgttgctaccccccccgggatgcccttagtaggactagcataccggggggggtagcaacagtggtgagttcgttggatggctgaagccctgagtacagggtagtcgtcagtggttcgacaccttagaatttaggtctcgagatgccacgtggacgagggcacgcccacagcacatcctaacctggacaggggtcgtccaggtgaaagcgggcaaccgttacggacacaacctgatagggtgctgcagaggcccactgtattgctactaaaaatctctgctgtacatggcac

SEQ ID NO: 332 - DNA, 349 bp, Pegivirus J
  isolate CC61, complete genome.1
ggacttcggtccccctgttactctgcgagccaccgcagagccagggttggtacgcccgaggtgttagaccccggccgaaagctcctaaccatggggttagtaggacgtggtaaatgccactgaggggttggagagctggtagagcgagtaagtcggcgtaaggcccgagtacgggcctcccagcccgggtcagcctaaacctggctgtgatacccggtgcatggagggcgtgtcccaacgctcgatcgctgtagggtgggtccctgcagttgggtgtggctaccctgctcgtactgcttgatagagtcccggcggacggaccagctctcgtcagtccgtggagttgcac

SEQ ID NO: 333 - DNA, 353 bp, Echovirus E9
  isolate NSW-V32-2008-ECHO9, complete genome.1
cccgtaggacgctctaatactgacatggtgcgaagagtcgattgagctagttagtaatcctccggcccctgaatgcggctaatcctaaccgcggaacacatgctcacataccagtgaggagtgtgtcgtaatgggcaactctgcggcggaaccgactactttgggtgaccgtgtttctttttattctcatactggctgcttatggtgacaattgaaagattgttaccatatagctattggattggccatccggtgacgaatagagcaattatatacttattcgttggatacatcccactcaactttaaagaactaagaactcttaattatatattgcaattaaatttcgcaaa

SEQ ID NO: 334 - DNA, 354 bp, Human enterovirus
  isolate EV/Human/CMRHP5B/CMR/2014 polyprotein1
acccataggacgctctaatgtggacatggtgcgaagagtctattgagctagttagtagtcctccggcccctgaatgcggctaatcctaactgcggagcgcatgcccccaaaccagggggaggtgcgtcgtaacgggcaactctgcagcggaaccgactactttgggtgtccgtgtttccttttatctttgcaatggctgcttatggtgacaattgagagattgttaccatatagctattggattggccatccggtgagcaatagagcgatcatctattcctttattggatttgtaccattggactatactgcctttgtcacattgaaatacattctattgttgaacactataaa

SEQ ID NO: 335 - DNA, 355 bp, Atypical porcine pestivirus 1
  isolate APPV-China/SWU-KZ/20181
gcattatgtatgggacatcctaaattggagtgagccccgtggtgagtgggggaaaggggttaaccaggcctctagtaccacaggcaccaatgaacagggcaactcgaacccgagagagaggtaccgaactcttaagccccgagtacggggcagacgtcaccgagtagtacacccaaagaccaccactaggtgtagggtctactgaggctcgggtggacgtgggcgtgcccaaagagaaatcggtggtggacctgggggtcggggccaccatacccctaaacagggtagaccttactgcttgatagagtgccggcggatgcctcgggcaagagtataaaatccgttgtctatcaac

SEQ ID NO: 336 - DNA, 356 bp, Border disease virus
  strain BD31 polyprotein gene, complete cds.1
gaactacatcatactcgtgtacaaaattggacattccaaaactcgattgggttagggagccctcctagcgacggccgaaccgtgttagccatacacgtagtaggactagcagacgggaggactagccatcgtggtgagatccctgagcagtctaagtcctgagtacaggacagtcgtcagtagttcaacgcaaacatgctctgcctgaaatgctacgtggacgaggcatgcccaagactgcttaatctcggcggggtcgccgaggtgaaacacctaccggtgttgggttacagcctgatagggcgctgcagggcccacgtataggctagtataaaaatctctgctgtacatggcac

SEQ ID NO: 337 - DNA, 358 bp, Pestivirus sp.
  isolate ovine/It/338710-2/2017 polyprotein gene,1
gttcattctcgtgtacaaaattgggcatataaatttctgattcgattagggaatccctctagcgacggccgaactgggctagccatgcccatagtaggactagcaaacggagggactagccgtagcggtgagctccctgggaagtctaagccctgagtacagggtagtcgtcagtagttcgacgtggacgagagtccatctcgagatgctacgtggacgagggcatgcccaagacataccttaacccaggcgggggtcgtctgggtgaaatcacttagcgtgatgggggtacaacctgatagggtgctgcagaggcccgctattaggctagtataaaaatctctgctgtacatggcac

SEQ ID NO: 338 - DNA, 359 bp, Human pegivirus
  gene for polyprotein, isolate 89860282.1
gtgatgccagggttggtaggtcgtaaatcccggtcatcttggtagccactataggtgggttttaagggagggttaaggtccctctggcgcttgtggcgagaaagcgcacggtccacaggtgttggccctaccggtgtgaataagggcccgacgtcaggctcgtcgttaaccaataggcaatgccggcgagttgacaaagaccagtgggggccgggcggcgggggaaggacccccgtcgccgcccttcccgggaggggtgggaaatgcatggggccacccagctccgcggcggcctgcagccggggtagcccaagagccttcgggtgagggcgggtggcatttcctttcttgtaccgatc

SEQ ID NO: 339 - DNA, 360 bp, Bovine viral diarrhea virus 2
  strain SD1301, complete genome.1
atacagattggatgttggcaaaaagtgaatcgataaatagggaaccttcccctcagcgaaggccgaaaggaggctagccatgtccttagtaggactagcaaagagaggggactagcggtagcagtgagttcattggatggccgaatccctgagtacagggaagtcgtcaatggttcgacgctctggcaacaaagagcctcgagatgccatgtggacgagggcatgcccacggcacatcttaacctatgcgggggttgcgtaggtgaaagcatcatcttgagatgttatggacacagcctgatagggtgtagcagagacctgctattccgctagtataaaaaactctgctgtacatggcac

SEQ ID NO: 340 - DNA, 363 bp, Human rhinovirus C
  strain HRV-C17_p1192_sR2967_2009 polyprotein1
cagggtcgcctttgtgtttgatgggttagtcgctcagtcagttaccccctgatagacctggcagatgaggttggaaacaccccactggtaacagtgttccagcctgcgtggctgcctgcccctctttttgaggggaagcccatatgtagacaaggtgagaagagccgcgtttgctaatcatgagtcctccggcccctgaatgcggctaatccaaccccacagctactgcgcagaaaccactgcgtgggtagtcgtaatgagcaattgtgggacggaaccgactactttgggtgtccgtgtttcctgttttaccttacattgcttatggtcacaacatatatgaaatcgtatatgttgttcacc

SEQ ID NO: 341 - DNA, 365 bp, Bovine viral diarrhea virus 1
  isolate SLO/2416/2002, complete1
gctcttgtatacaaattggacatccacaaattaaaaatccggcctagggaaaaatccctctcagcgaaggccgaaaagaggctaaccatgcccttagtaggactagcaaaaggagaggggtagcaacagtggtgagttcgttggatggctgaagccctgagtacagggtagtcgtcagtggttcaacacctcggaaagaaggtcttgagatgccacgtggacgagggcatgcccacagcacatcttaacctggacgggggtcgcccaggtgaaagcagttttaaccaactgttatgaacacagcctgatagggtgctgcagaggcccactgcattgctactaaaaatctctgctgtacatggcac

SEQ ID NO: 342 - DNA, 366 bp, Classical swine fever virus
  isolate IND/AS/GHY/G4, complete genome.1
aggttagttcgttctcgtatgtaatatcggacaaactaaaattctgatttggtttagggcacccctccagcgacggccgaactgggctagccatgcctatagtaggactagcaaacggagggactagccgtagtggcgagctccctgggtggtctaagtcctgagtacaggacagtcgtcagtagttcgacgtgagcaggggctcacctcgagatgctatgtggacgagggcatgcccaggacacaccttaaccctagcgggggtcgctagggcgaaatcacgctatgtgatgggggtacgacctgatagggcgctgcagaggcccactaacaggctagtataaaaatctctgctgtacatggcac

SEQ ID NO: 343 - DNA, 367 bp, Rodent pestivirus
  isolate RtNe-PestV/SC2014 polyprotein gene,1
tataagctgggggtgggagcccagcttgtactaaagtttacagcacgtgtgtgaagtttacttagtcctgtagaggtgacggggataacctatgccagtgggtgtgtaccagtaaccattgaactacagggactgcaacctgggagagcacctagagcccctaaggcatgagcacatgccattcgtcaagtggtcagctggaaaggatcacccacctggaaaccactgtggacgagggtattcacccaagggtaactctattaattggggggggccccaattatcaacacaattgtgttgggtgtgctgcctgacagggtcccggctgatggcccaggaagcagtataatatcagttgttttggcac

SEQ ID NO: 344 - DNA, 369 bp, Border disease virus
  isolate R4785/06, complete genome.1
gtatacgagagtagctcatgctcgtatacaaaattggacattctaaaagattaattggactaggattccctcccagcgacggccgaaccgggttagccatacctgcagtaggactagcagacgggaggactagctatcgtggtgaggtccctgagtggtctaagtcctgagtacaggacagtcgtcagtagttcgacacaaacttttgtctcgaggtgctacgtggacgagggcgtgcccaagacacactttaaccctggcgggggtcgctagggtgaaagcgcctaacggcgttggaactacagcctgatagggtgctgcagaggcccacgtaccagctagtataaaaatctctgctgtacatggcac

SEQ ID NO: 345 - DNA, 369 bp, Pronghorn antelope pestivirus
  complete genome.1
gtatacgcagttagttcatcctgtgtatacagattggagactctaaaaacaacgattcggaataggggcccgcggcgaagaccgaagacaggctaaccatgccgttagtagggctagcaccaaaacgcgggaactagacacttaggagagtggtctggctactctaagaggtgagtacaccttaaccgtcaagggttctactcctcagttgaggactagagatgccctgtggacgggggcatgcccaagagttagcttagccggggcgggggttgttccggtgaaagtagcaatattgaccacactgcctgatagggcggagcaggccccctaggtagtctagtataaaatgtctgctgtacatggcac

SEQ ID NO: 346 - DNA, 369 bp, Porcine pestivirus 1
  isolate ISDVDL2014016573 polyprotein gene,1
ggccaattaaagcattatgcgtgggacatcctaaatatttatgagccctgcggtgagtgggggaaagaggttaaccaggcctctagtaccacaggcaccaatggacagggcaactcaaacctgagagagaggtaccgaactcttaagccccgagtacggggcagacgtcaccgagtagtacacccaaagaccaccacttctaggtgtagggtctactgaggctcgggtggacgtgggcgcgcccaaagagaaatcggtggtggacctgggggtcggggccaccatgcccctttacggggtagaccttactgcttgatagagtgccggcggatgcctcaggtaagagtataaaatccgttgttcattaac

SEQ ID NO: 347 - DNA, 370 bp, Pestivirus reindeer-1
  V60-Krefeld complete genome.1
gtatacgaaagtagctcacgttcgtatacaaaattgactgtaccaaatccccaattcggttagggcccctcccagcgacggccgaaccgggttagccatacccgtagtaggactagcaaacgggaggactagcttacgtggtgagatccctgagtggtctaagtcccgagtacggggcagtcgtcagtagttcaacgcaatgtggagttgccttgagatgctacgtggacgagggcatgcccaagacacactttaaccctggcgggggtcgccaggtgaactcacctaatggtgttgggattacagcctgatagggtgctgcagaggcccacgcataagctagtataaaaatctctgctgtacatggcac

SEQ ID NO: 348 - DNA, 370 bp, Border disease virus
  strain Aveyron, complete genome.1
gtatacgagagtagctcaagtctcgtatgcagattggatacacaaaattgttgaattggtgtagggcccccagcgacggccgaactaggctaaccatgcccacagtaggactagcatacggggggactagctttcgtggtgagatccctgagcggtctaagccctgagtacagggtagtcgtcagtagttcgacacaaacgtggttttgtctcgagatgctacgtggacgagggcatgcccatgacacgctttaggcccggcaggggtcgccgggtcgaaaacacctcactgtgttggggttacagcctgatagggtgctgcagaggcccacgcataagctagtataaaaatctctgctgtacatggcac

SEQ ID NO: 349 - DNA, 370 bp, Bovine viral diarrhea virus 1
  strain USMARC-55477 polyprotein gene,1
gtaaaatactcgtatacatattggaaaagaaaaaaataataattaggcctagggaacaaatcctcctctgcgaaggccgaaaagaggctagccatgcccttagtaggactagcacaatgaggggggtagcaacagtggtgagttcgttggatggcttaagccctgagtacagggtagtcgtcagtggttcgacaccttggcataaaggtctcgagatgccacgtggacgagggcatgcccaaagcacatcttaaccagggcgggggtcgctctggtaaaagcagttagatcaactgttatgaatacagcctgatagggtgctgcagaggcccactgtattgctactaaaaatctctgctgtacatggcac

SEQ ID NO: 350 - DNA, 370 bp, Sicinivirus A4
  strain RS/BR/2015/1 polyprotein gene, complete cds.1
cccgattgctgtcctgcttgtctggtgaactcggctggaagcattcagtttctggatttgctggtttgtggtgattagtagaccccctggaggtacccgtctggatctgaccagggacccgtgactataccgttccggtaattcgggtttaaaactatgaacgtcaccacccattttgttttgtttggttgggctggattgtttgtttagatgctcctagaatccctgttggtgattgtagcacttgttgtagtggtcgtctctcctagtgaattaccccagctgtttgctatttgcatctacaactttgtcttgatttttctctggttatttggtaccttagagctccccaattatcccaccattcatc

SEQ ID NO: 351 - DNA, 370 bp, Pasivirus A3
  complete genome.1
tacctaaaggttcggacacaactccgcgcttcagcctccttaccaaaacaggtgggcagccctgtcttatacttagtggaaacgggaaccaaacgaagtgctttcggttccgttgcaaaaagcatttccgcaggcattacgagcacgtcacgaccacctggtggactgtgggcgagcgtggatctgagagacagggggatgcctgcattttagtaactttcaaaaactcctgtcaaagacaggacttcctcaaaactgtgcctttgccgccaggaatgcaagcgcaaggaattaccatgcatttagactattaacagacaatcttgcattgcacctgcagtgaaggacatctttgtgcagaaaaactgtg

SEQ ID NO: 352 - DNA, 371 bp, Bovine viral diarrhea virus 1
  isolate SLO/3301/2014, complete1
agttctcgtatacacattggacactctaaaaatatattgtaattaggtctaggggactaaatcctccttagcgaaggccgaaaagaggctagccatgcccttagtaggactagcacaataaggggggtagcaacagtggtgagttcgttggatggctgaagccctgagtacagggtagtcgtcagtggttcgacgcctcggaggacaggcctcgagatgccacgtggacgagggcacgcccacagcacatcttaacctgaacgggggtcgtttaggtgaaagcggtttaaccaaccgctacgaatacagcctgatagggtgctgcagaggcccactgtattgctactgaaaatctctgctgtacatggcac

SEQ ID NO: 353 - DNA, 372 bp, Border disease virus
  isolate Coos Bay 5 c, complete genome.1
gtatacgggagtagctcatacccgtatgcaaaattggacgtctcaaaattcgattgggtgagggagccctcctagcgacggccgaaccgtgttaaccatacacgtagtaggactagcaaacgggaggactagccatcgtggtgagatccctgagcagtctaagtcctgagtacaggatagtcgtcagtagttcaacgcaggcgtggttctgccttgagatgctacgtggacgagggcatgcccaagacatgctttaatcccgacgggggtcgccgggatgaaaacacctactggtgttgggattacagcctgatagggtgttgcagagacccacgtataggctagtataaaaatctctgctgtacatggcat

SEQ ID NO: 354 - DNA, 372 bp, Border disease virus
  strain X818, complete genome.1
gtatacgggagtagctcatgcccgtatacaaaattggatattccaaaactcgattgggttagggagccctcctagcgacggccgaaccgtgttaaccatacacgtagtaggactagcagacgggaggactagccatcgtggtgagatccctgagcagtctaaatcctgagtacaggatagtcgtcagtagttcaacgcaggcacggttctgccttgagatgctacgtggacgagggcatgcccaagacttgctttaatctcggcgggggtcgccgaggtgaaaacacctaacggtgttggggttacagcctgatagggtgctgcagaggcccacgaataggctagtataaaaatctctgctgtacatggcac

SEQ ID NO: 355 - DNA, 372 bp, Classical swine fever virus
  strain 94.4/IL/94/TWN, complete genome.1
gtatacggtgttagctcatcaccgtatgcaagattggacaaaccaaatctcaatctggctcagggcatccctccagcgacggccgaactgggctagccatgctcatagtaggactagcaaacggagggactagccgtagtggcgagctccctgggtggtctaagtcctgagtacaggacagtcgtcagtagttcgacgtaagcggaagctcacctcgagatgctacgtggacgagggcatgcccaagacacaccttaaccctggcaggggtcgccagggtgaaatcacactatgtgaggggggtacgacctgatagggtgctgcaggggcccactattaggctagtataaaaaactctgctgtacatggcac

SEQ ID NO: 356 - DNA, 372 bp, Wood duck megrivirus
  isolate WDMeV/6497nt/WD08.18-AU-20181
tgggctcttttccgtacggtggcgtgacgaaccaccgtgcgtgaccctgctaagtcgtctgtgcctctcgggcatgtcgtggctccggctccgatatgcttgggacaacggatgggcggcttggtggggctagtcaccccgtttttggacttcctggttttgactccctctttgtctttcgggcttggtccaccgacggactaattggtatctgcaaggcctatagcctcgttctgaaatgccctagccaaagggacgtagtaggatcttggtgtttcccttgcagctctaccgaccgtattagctagagctaggactgtgcaggatgtttcagacctctttttgagcaatctgggacaagaccccggtctg

SEQ ID NO: 357 - DNA, 373 bp, Bovine viral diarrhea virus 1
  isolate VE_138cp_05 genome assembly,1
actagataaaatactcgtatacgtattgggcatttaaaaatataattaggcctagggaataaatccccctctgcgaaggccgaaaagaggctagccatgcccttagtaggactagcataatgaggggggtagcaacagtggtgagttcgttggatggcttaagccctgagtacagggtagtcgtcagtggttcgacgccttgtcgcaaaggtctcgagatgccacgtggacgagggcacgcccaaagcacatcttaacctgagcgggggtcgctcaggcgaaagcagtttaaccaactgttacgaatacagcctgatagggtgctgcagaggcccactgtattgctactaaaaatctctgctgtacatggcac

SEQ ID NO: 358 - DNA, 373 bp, Classical swine fever virus
  isolate CSFV-UP-GZ-NVD-11, complete1
gtatacgaggttagttcattctcgtatgcattattggacaaatcaaaatttcaatttggttcagggcctccctccagcgacggccgaactgggctagccatgcccatagtaggactagcaaacggagggactagccatagtggcgagctccctgggtggtctaagtcctgagtacaggacagtcgtcagtagttcgacgtgggcagaggcccatctcgagatgctatgtggacgagggcatgcccaagacacaccttaaccctggtgggggtcgctagggtgaaatcacacaacgtgatgggggtacgacctgatagggtgctgcagaggcccactaacaggctagtataaaaatctctgctgtacatggcac

SEQ ID NO: 359 - DNA, 373 bp, Classical swine fever virus
  strain JJ17LOM-JSJ12, complete genome.1
gtatacgaggttagttcattctcgtatgcatgattggacaaattaaaatttcaatttggatcaggtcctccctccagcgacggccgaagtgggctagccttgcccgcagttggactagcaaacggagggactagccgtattggcgagctccctgggtggtctaagtcctgagtacaggacagtcgtcagtagttcgacgtgagcagaagcccacctcgatatgctatgtggacgagggcatgcccaagacacatcttaaccctagcgggggtcgctagggtgaaatcacaccacgtgatgggagtacgacctgatagggtgctgcagaggcccactattaggctagtataaaaatctctgctgtacatggcac

SEQ ID NO: 360 - DNA, 373 bp, Sicinivirus 1
  strain UCC001, complete genome.1
gtgtcattaaggtgtgtttggaagttcgaattagctggtttgtggtgattagtagaccccctggaggtacccaattcggatctgaccagggacccgtgactataccgctccggtaattcgggtttaaaacaatgaacgtcaccacacaattacttttctcattttattttcatcattgtcttcctatttaccgattacactcgatttccttggatgttcctggagatttccctggttacctggaccctcattattgttgttgtttcacccagcgagctgtcccaattgcttattatttgcgcttacaacttcgtcctaatatttttctggttgatcgggttgattgagctcccgggctatcctgccattcaac

SEQ ID NO: 361 - DNA, 374 bp, Classical swine fever virus
  strain CSFV/1.4/dp/CSF1058/2010/Pinar1
gtatacgaggttagctcattctcgtatacatgatcggacaaatcaaaatctcaatttggttcagggcctccctccagcgacggccgaactgggctagccatgcccacagtaggactagcaaacggagggactagccatagtggcgagctccctgggtggtctaagccctgagtacagggcagtcgtcagtagttcgacgtgagcagaagcccacctcgagatgctatgtggacgagggcatgcccaagacacaccttaactctagcgggggttgctagggtgaaatcacaccatgtgatgggagtacgacctgatagggcgctgcagaggcccactattaggctagtataaaaaatctctgctgtacatggcac

SEQ ID NO: 362 - DNA, 374 bp, Border disease virus
  gene for polyprotein, complete cds, strain:1
gtatacggggtagctcatgcccgtgtacaaaattggactttccaaaaaactcaattggattagggagccctcctagcgacggccgaaccgtgttagccatacacgtagtaggactagcagacgggaggactagccatcgtggtgagatccctgagcggtctaagtcctgagtacaggatagtcgtcagtagttcaacgcagacatggttctgccttgagatgctacgtggacgagggcatgcccaagacgcgctttaatcctggcgggggtcgccagggtgaaaacacataccagtgttggggttacagcctgatagggtgctgcagaggcccacgtataggctagtataaaaaatctctgctgtacatggcac

SEQ ID NO: 363 - DNA, 374 bp, Classical swine fever virus
  strain JJ9811, complete genome.1
gtatacgaagttagctcaccctcgtatacataattgggcaggtcaaaattccaatttggttcagggcccccctccagcgacggccgaactgggctagccatgcccacagtaggactagcagacggagggactagccgtagtggcgagctccctgggtggtctaagtcctgagtacaggacagtcgtcagtagttcgacgtgagcagcagctcatctcgagatgctatgtggacgagggcatgcccaagacacaccttaatcctggcgggggtcgccagggtgaaatcacactgcgtgatgggggtacgacctgatagggtgctgcagaggcccactattaggctagtataaaaaatctctgctgtacatggcac

SEQ ID NO: 364 - DNA, 374 bp, Classical swine fever virus
  strain CSFV/2.3/dp/CSF857/2006/Borken,1
gtatacgaggttagctcgttctcgtatacgatattggatacactaaatttcgatttggtctagggcacccctccagcgacggccgaaatgggctagccatgcccatagtaggactagcaaacggagggactagccgtagtggcgagccccctgggtggtctaagtcctgagtacaggacagtcgtcagtagttcgacgtgagcaccagcccacctcgagatgctacgtggacgagggcatgcccaagacacaccttaaccctggcgggggtcgctagggtgaaatcacattatgtgatgggggtacgacctgatagggtgctgcagaggcccactattaggctagtataaaaaaatctctgctgtacatggcac

SEQ ID NO: 365 - DNA, 374 bp, Bovine viral diarrhea virus 1
  isolate GXNN1, complete genome.1
ggaaaaaacactcgtatacatattgggcgattctaaaacgataattaggcctagggaatgaatccccttcagcgaaggccgaaaagaggctagccatgcccttagtaggactagcataatggagggggtagcaacagtggtgagttcgttggatggcttaagccctgagtacagggcagtcgtcagtggttcgacaccttggaagaacaaggcctcgagatgccacgtggacgagggcatgcccaaagcacatcttaacccgggcgggggtcgctcaggtgaaagcagtttaaccaactgttacgaatacagcctgatagggtgctgcagaggcccactgtattgctactaaaaatctctgctgtacatggcac

SEQ ID NO: 366 - DNA, 374 bp, Human enterovirus
  isolate EV/Human/CMRHP55/CMR/2014 polyprotein1
ggtacctgtggctaaaagccacaggacgctagttgtgaacaaggtgtgaagagtctattgagctacaagagagtcctccggcccctgaatgcggctaatcccaaccatggagcaagtgctcacgcaccagtgagtagcttgtcgtaacgggtaactctgtggcggaaccgactactttgggtgtccgtgtttccttttatttttataatggctgcttatggtgacaatctcagattgttatcataaagcgaattggattggccatccggtgaaagtgagatatattatatacctttttgttggatttactccaatcaattccttcacttatcagctcatcactataactctgttgattagaagcatataccaca

SEQ ID NO: 367 - DNA, 375 bp, Classical swine fever virus
  strain GD19/2011, complete genome.1
gtatacgaggttagttcgttctcgtgtacaatattggacaagaccaaaattccgatttggcctagggcacccctccagcgacggccgaactgggctagccatgcccacagtaggactagcaaacggagggactagccgtagtggcgagctccctgggtggtctaagtcctgagtacaggacagtcgtcagtagttcgacgtgagcaggagcccacctcgagatgctatgtggacgagggcatgcccaagacacaccttaaccctggcgggggtcgccagggtgaaatcacaccatgtgatgggggtacgacctgatagggtgctgcagaggcccactaacaggctagtataaaaaatctctgctgtacatggcac

SEQ ID NO: 368 - DNA, 375 bp, Pestivirus Burdur/05-TR
  complete genome.1
gtatacgagattagctcacactcgtatacaaattggatatgacaaattcaaattggactagggactccctctagcgacggccgaacggggttaaccatacctctagtaggactagcaaacggagggactagctatagtggtgagctccctgggaggtctaagttccgagtacggaatagtcgtcagtggttcaacgccggtaaaccccggccttgagatgccacgtggacgagggcatgcccaagacacaccttaacctgggcgggggtcgtccaggtgaaaacacccctttttgggtgctgggggtacagcctgatagggtgctgcagaggcccactaataggctagtataaaaatctctgctgtacatgagac

SEQ ID NO: 369 - DNA, 375 bp, Bovine viral diarrhea virus 1
  isolate MA_101_05 genome assembly,1
atttagaaaaggttctcgtatacgtattgggcaatcaaaaataatgattaggcctagggaacaaaccctctcagcgaaggccgaaaggaggctagccatgcccttagtaggactagcaaaatgaggggggtagcaacagtggtgagttcgttggatggctgaagccctgagtacagggcagtcgtcagtggttcgacacctaggatggtaggtctcgagatgccacgtggacgagggcatgcccacagcacatcttagcctgagcgggggtcgcccaggtgaaagcggtacagacagaccgctacgaatacagcctgatagggtgctgcagaggcccactgcaatgctactaaaaatctctgctgtacatggcac

SEQ ID NO: 370 - DNA, 376 bp, Border disease virus
  strain Gifhorn clone pBeloGif3, complete1
gtatacgagagtagttcaggctcgtatgcaaaattgggtgtttcaaattttaaaattcgactagggccaccccccagcgacggccgaaacgggttagccatacccttagtaggactagcggacggggggactagccatcgtggtgagatccctgagcggtctaagtcctgagtacaggacagtcgtcagtggttcgacgcggtcatcgcatcgtctcgagatgccacgtggacgagggcatgcccaagacacgctttaatcctggcgggggtcgccagggtgaaaacgtcctagtggcgttggggttacagcctgatagggtgctgcagaggcccacgcataggctagtataaaaaaactctgctgtacatggcac

SEQ ID NO: 371 - DNA, 376 bp, Border disease virus
  strain H2121 (Chamois-1), complete genome.1
gtatacgagagtagctcatgctcgtatacagattggacacgctaaattttttaattagggttagggtgttccccccagcgacggccgaactgggttagccatacccatagtaggactagcagacgggaggactagccatcatggtgaggtacctgagcggtctaagccctgagtacagggcagtcgtcagtagttcgacactaacttggcttagtctcgagatgctacgtggacgagggcatgcccatgacacgctttagccccagcgggggtcgttggggtgaaaacacattacggtgctggtatcacagcctgatagggtgctgcagaggcccatgaataggctagtataaaaaatctctgctgtacatggcac

SEQ ID NO: 372 - DNA, 376 bp, Bovine viral diarrhea virus 1
  isolate SLO/2407/2006, complete1
agatttaggaaagctctcgtatgcatattgggcaatctaaaataataattagacctagggaacaatccctctcagcgaaggccgaaaggaggctagccatgcccttagtaggactagcaaaatgaggggggtagcatcagtggtgagttcgttggatggctgaagccctgagtacagggcagtcgtcagtggttcgacgcctaggatgataggtctcgagatgccacgtggacgagggcatgcccacagcacatcttagcccgagcgggggtcgcccgggtgaaaacggtaaatacagaccgctacgaatacagcctgatagggtgctgcagaggcccactgtaatgctactaaaaaactctgctgtacatggcac

SEQ ID NO: 373 - DNA, 377 bp, Border disease virus
  isolate R9336/11, complete genome.1
gtatacgagagtagttcatgctcgtatacagaattggatattctaaaatttgttaattggactagggtctcctcctggcgacggccgaaccgggttagccatacccgtagtaggactagcatatgggaggactagctttcgtggtgaggttcctgagtggtctaagtcctgagtacaggatagtcgtcagtagttcgacacaaacggagttttagtctcgagatgctacgtggacgagggcatgcccaagactcactttaatcctggcgggggtcgccagggtgaaaacgcccaatggcgttggaactacagcctgatagggtgctgcagaggcccacgcaacagctagtataaaaaatctctgctgtacatggcac

SEQ ID NO: 374 - DNA, 377 bp, Pestivirus
  strain Aydin/04-TR, complete genome.1
gtatacgagattagctcatactcgtgtacaaattggacgtagcaaatttaaaaattcggatagggtccccatccagcgacggccgaacggggttaaccatacctctagtaggactagcagacggatggactagccacagtggtgagctccctgggaggtctaagttctgagtacagaacagtcgtcagtagttcaacgctggtaaaccccagccttgagatgctacgtggacgagggcatgcccaagacacaccttaacctggacgggggtcgtccaggtgaaagtacccatctttgggtgctgggagtacagcctgatagggcgctgcagaggcccactgacaggctagtataaaaatctctgctgtacatggaac

SEQ ID NO: 375 - DNA, 377 bp, Bovine viral diarrhea virus 1
  isolate SLO/1361/2014, complete1
agatttagctcaatctctcgtatgcacattgggcaagcaaaataacaattaggcctagggaaaaaataatcctcctcagcgaaggccgaaaagaggctagccatgcccttagtaggactagcatattggggagggtagcaacagtggtgagttagttggatggctgaagccctgagtacagggtagtcgtcagtggttcgacgccttagaatacaggcctcgagatgccacgtggacgagggcatgcccacagcacatcttaacctgagcgggggtcgcccaggtaaaagcggatgaaaaccgttactaacacagcctgatagggtgctgcagaggcccactgcactgctactaaaaatctctgctgtacatggcac

SEQ ID NO: 376 - DNA, 377 bp, Atypical porcine pestivirus
  isolate 5620 polyprotein gene, complete1
gcataatgcttagattggctgcattatgtttgggacatcctaaatttttatgagccctgtggtgagtgggggaaaggggttaaccaggcctctagtaccacaggcaccaatggacagggcaactcgaacctgagagagaggtaccgaactcttaagtcccgagtacggggcagacgtcaccgagtagtacacccaaagaccaccacttttaggtgtagggtctactgaggctcgggtggacgtgggcgtgcccaaagagaaatcggtggtggacccgggggtcgggaccaccatgcccttcacggggcagaccttactgcttgatagagtgccggcggatgcctcgggtgagagtataaaatccgttgtttattaac

SEQ ID NO: 377 - DNA, 378 bp, Bovine viral diarrhea virus 2
  isolate McCart_c, complete genome.1
ttgcatggtacgggctgagctacggattggatgttgacaaattttgaattggcaaagtaggtaactttcccctcagcgaaggccgaaaagaggctagccatgcccttagtaggactagcaaaaggaggggactagcggtagcagtgagttcattggatggccgaacccctgagtacaggggagtcgtcaatggttcgacactccatcattcatggagtctcgagatgccatgtggacgagggcatgcccacggcacatcttaacctatgcgggggttgcatgggtgaaagcgccattcgtggcgttatggacacagcctgatagggtgtagcagagacctgctattccgctagtaaaaaactctgctgtacatggcac

SEQ ID NO: 378 - DNA, 378 bp, Atypical porcine pestivirus
  isolate GX02-2019 polyprotein gene,1
gcataatgctttgattggctgcattatgtgttggacacctcaaattaccacgcgccctgcggtgagtgggggaaaggggttaaccaggcctctagtaccacagacaccaattggcagggcaactcaaacctgagagagaggtaccgaactcttaagccccgagtacggggcagacgtcaccgagtagtacacccaaagaccaccatgtttaggtgtagggtctactgaggcttgggtggacgtgggcgtgcccaaagagaaatcggtggtggacctgggggtcgggcccaccacacccctttatggggtggaccttactgcttgatagagtgccggcggatgcctcaggtaagagtataaaatccgttgtttattaac

SEQ ID NO: 379 - DNA, 378 bp, Porcine pestivirus 1
  complete genome.1
gcataatgctttgattggctgcattatgtgtgggacatcctaaattgtcataagccctgcggtgagtgggggaaaggggttaaccaggcctctagtaccacaggcacctatggacagggcaactcaaacctgagagagaggtaccgaactcttaagtcccgagtacggggcagacgtcaccgagtagtacacccaaagaccaccatttctaggtgtagggtctactgaggctcgggtggacgtgggcgtgcccaaagagaaatcggtggtggacctgggggtcggggccaccataccccgttatggggtagaccttactgcttgatagagtgccggcggatgcctcgggtaagagtataaaatccgttgtctattaac

SEQ ID NO: 380 - DNA, 378 bp, Atypical porcine pestivirus
  isolate NL11 Farm10 polyprotein gene,1
gcataatgctttgattggctgcattatgtatggaacatcctaaattgttgtgagccccgtggtgagtgggggaaaggggtttaccaggcctctagtaccacaggcaccgatagacggggcaactcgaacctgagagagaggtaccgaactcttaagtcccgagtacggggcagacgtcaccgagtagtacacccaacgaccaccactcctaggtgtagggtctactgaggctcgggtggacgtgggcgcgcccaaagagaaatcggtggtggacctgggggccggggccaccatgctcctttacggggtagaccttactgcttgatagagtgccggcggatgcctcgggtaagagtataaaatccgttgtctattatt

SEQ ID NO: 381 - DNA, 378 bp, Swine pasivirus 1
  complete genome.1
gcttttgaccagtggctctgggttacttagccaagtccctttctcttattttcactagtttatgttgtgtgttgtctgttttgttttgtttaaattgtatacaagatccttcccgccgacacagacctcgacagtctggtgtaggagggttggtgatattaatttgccccaaaagagtgaccgtgatacgtggaaaccatgagtacatgtgtatccgtggaggatcgcccgggactggattccatatcccattgccatcccaacaaacggagggtatacccaccacgtgcgcgtttgcagtgggaatctgcaaatttagtcatactgcctgatagggtgtgggcctgcactttggggtactcaggctgttcatataat

SEQ ID NO: 382 - DNA, 379 bp, Bovine viral diarrhea virus 2
  isolate 1786c polyprotein gene,1
tcctcgttgaaattctcgtatacagattgggtgttggcaaacagttaattagtgaagtagggaaccttcccccctctgcgaaggccgaaaagaggctaaccatgcccttagtaggactagcaaaaagagggggctagcggtagcagtgagtttattggatggccgaatccctgagtacagggaagtcgtcaatggttcgacactctggtaatataagagtctcgagatgccatgtggacgagggcatgcccacggcacatcttaacctatgcgggggttgcatgggtgaaagcaccatttacggtgttataaacacagcctgatagggtgtagcagagacctgctatcccgctagtaaaaactctgctgtacatggcac

SEQ ID NO: 383 - DNA, 379 bp, Classical swine fever virus
  isolate LK-VNIVViM, complete genome.1
gcatactcaggacttagaccaccctcgcatctgcatgatatcggacaaatcaaatttcaatttggttcagggcctccctccagcgacggccgaactgggctagccatgcccacagtaggactagcaaacggagggactagccgtagtggtgagctccctgggtggtctaagtcctgagtacaggacagtcgtcagtagttcgacgtgagcagaagcccacctcgagatgctacgtggacgagggcatgcccaagacacaccttaaccctagcgggggtcgctagggtgaaatcacaccacgtgatgggagtacgacctgatagggtgctgcagaggcccactattaggctagtataaaaatctctgctgtacatggcac

SEQ ID NO: 384 - DNA, 379 bp, Atypical porcine pestivirus
  isolate GX01-2019 polyprotein gene,1
gcataatgctttgattggctgcattatgtatgggacatcctaaattgctacgagccctgcggtgagtgggggaaaggggttaaccaggcctctagtaccacaggcaccaataaacagggcaactcgaacctgagagagaggtaccgaactcttaagtcccgagtacggggcagacgtcactgagtagtacacccaaagaccaccacatctaggtgtagggtctactgaggctcaggtggacgtgggcgtgcccaaagagaaatcggtggtggacctgggggtcgggtccaccatgccccctttagggggtagaccttactgcttgatagagtgccggcggatgcctcgggtaagagtataaaatccgttgttcattaac

SEQ ID NO: 385 - DNA, 380 bp, Atypical porcine pestivirus
  isolate APPV-China/HeNLY/2017, complete1
tgcataatgcttcgattggctgcattatgtgtgggacatcctaaattgttaagcgccctgcggtgagtgggggaaaggggttaaccaggcctctagtaccacaggcaccattggacagggcaactcgaacctgagagagaggtaccgaactcttaagctccgagtacggggcagacgtcaccgagtagtacacccaacgaccaccatgtttaggtgtagggtctactgaagctcgggtggacgtgggcgtgcccaaagagaaatcggtggtggacctgggggtcgggcccaccatgccccccttacggggtagacctcactgcttgatagagtgccggcggatgcctcaggtgagagtataaaatccgttgttcgttaac

SEQ ID NO: 386 - DNA, 380 bp, Sicinivirus sp.
  strain RS/BR/2015/3R polyprotein gene, complete1
ttttgtcccgattgttgcaacattggcttggggaaccgaactcggttgcatttaagttgtgaacttgttggtctgtgatgattagtagaccccctggaggtacccgtctggatctgaccagggacccgtgactataccgttccggtaattcgggtttaaaacaatgaacgtcatcactcaacattctttcccattttattttgtatcttactgtcttagtatgctcattgagatttcgctggtagttgttgctttggttgtagtggttgtttcgcacagtgagtctcatcagcttctcacagtttgtatctacaattttgctttgaccttcctttggctgttcggatttcttgaacttcctaactatcctgctgttcaac

SEQ ID NO: 387 - DNA, 380 bp, Porcine teschovirus 2
  isolate JF613 polyprotein gene, complete cds.1
ttggaagctaggtacttgttacgctagttttggattgtcttgtgcccaacattagtctttggacttctgttgtgtttaaacacagaaatttgaacatttggctatagattcacaggataaaccctttgaaagacctgctctggcgcgagctaaagcgcaattgtcaccgggtattgcaccaatggtggcgacagggtacagaagagcaagtactcttgactgggtaatgggactgcgttgcatatccctaggcacctattgagatttctctggggcccaccagcgtggagttcctgtatgggaatgcaggactggacttgtgctgcctgacagggtcgcggctggccgtctgtactttgtatagtcagttgaaactcact

SEQ ID NO: 388 - DNA, 381 bp, Linda virus
  strain Austria1, complete genome.1
gtatagcagcagtagctcaaggctgctatacgattggacataccaaattccaattggtgttagggaccacctaggtgaaggccgacgacaggtagccattcctgttagtaggacgaaccgttatggtggactggttgctcaggtgagcaggctgcaatgcgtaagtggtgagtacaccacagccgtcaaaggtgccactggtaaggatcacccactggcgatgccttgtggacgggggcgtgcccaacgcaatgttagcggtggcgggggctgccatcgtgaaagctaggtcttgatggaccttgttgcctgtacagtctgataggatgccggcggatgccctgtgacagccagtataaagaatatccgttgtgattgcac

SEQ ID NO: 389 - DNA, 381 bp, Pestivirus PG-2
  complete genome.1
gtatacgagattagctcatcactcgtatacataatcggatataaccaaaacaatgatttggcataggaaataccccgatgcgaaggccgaaacaggctaaccatgcctttagtaggactagcacaaaatcggggactagccaaggtggcgagcttcctggatgaccgaagtcctgagtacaggacagtcgtcaacagttcaacgcgcaggacaggtctgcgtcttgatatgctgtgtggacgagggcatgcccacggtacatcttaacccagccgggggtcggttgggtgaaagtccaataggactggaagtacggcctgatagggtgtagcagagacccacctgttaggctagtataaaatactctgctgtacatggcac

SEQ ID NO: 390 - DNA, 382 bp, Pestivirus giraffe-1 H138
  complete genome.1
gtatacgagtttagctcaatcctcgtatacaatattgggcgtcaccaaatatagatttggcataggcaacaccccgatgcgaaggccgaaaagggctaaccatgcccttagtaggactagcaaaaaatcggggactagcccaggtggtgagcttcctggatgaccgaagccctgagtacagggcagtcgtcaacagttcaacacgcagaataggtttgcgtcttgatatgctgtgtggacgagggcatgcccacggtacatcttaacctatccgggggtcggataggcgaaagtccagtattggactgggagtacagcctgatagggtgttgcagagacccatctgataggctagtataaaaaactctgctgtacatggcac

SEQ ID NO: 391 - DNA, 382 bp, Bovine viral diarrhea virus 1m
  isolate LN-1, complete genome.1
gtatacgagaattagatcaatctctcgtatacacattgggcatcccaaacagcaattaggcatagggaaaatcctcctcagcgaaggccgaatagaggctagccatgcccttagtaggactagcaaattgaggggggtagcagcagtggcgagttcgttggatggctgaagccctgagtacagggtagtcgtcagtggttcgacgccttaggatctaaggcctcgagatgccacgtggacgagggcatgcccacagcacatcttaatccgagcgggggtcgctcgggtgaaagctgttgtgctaacagttatgaacacggcctgatagggtgctgcagaggcccactgtgttgctactaaaaatctctgctgtacatggcac

SEQ ID NO: 392 - DNA, 382 bp, Phocoena pestivirus
  isolate NS170386, complete genome.1
gtatacacaaggttagctcaatccattgtgtgtacgattggatgttgcaaatttataatttgagatatagggacccattcatcacagcgaaggccgaacaagggtagccaatcccttcattaggactagcacaagtgatggactggagacgtggatgagtgagctgtagagaggaagtggtgagtacaccacagtcgtcaagagtactaccggtaaggatcacccgctagttatgctctgtggacgagggcatgcccaccttttctactagataccccgggggttggggtgtcgaaagtcgaaatatcgattgctcacacagtctgataggatgccggcggatgctccacgtataccagtataaaaatccgttgaatagcac

SEQ ID NO: 393 - DNA, 383 bp, Unknown
  Description of Unknown: cDNA to genomic RNA of bovine viral diarrhea virus.1
atgtatacgagaatttgcctaacctcgtatacatattgggcattctaaaaataaattaggcctaagggacaaatcctccttagcgaaggccgaaaagaggctagccatgcccttagtaggactagcaaaacaaggagggtagcaacagtggtgagttcgttggatggctgaagccctgagtacagggtagtcgtcagtggttcgacgcttcgtgtgacaagcctcgaggtgccacgtggacgagggcatgcccacagcacatcttaacctgagcgggggtcgttcaggtgaaagcggtttaaccaaccgctacgaatacagcctgatagggtgctgcagaggcccactgtattgctactaaaaatctctgctgtacatggcac

SEQ ID NO: 394 - DNA, 383 bp, Bovine viral diarrhea virus 3
  Th/04_KhonKaen, complete genome.1
gtatacgcccagttagttcaggtggacgtgtacgattgggtatcccaaattaataatttggtttagggactaaatcccctggcgaaggccgaaacaggttaaccatacctttagtaggacgagcataatgggggactagtggtggcagtgagctccctggatcaccgaagccccgagtacggggtagtcgtcaatggttcgacgcatcaaggaatgcctcgagatgccatgtggacgagggcgtgcccacggtgtatcttaacccaggcgggggccgcttgggtgaaatagggttgttatacaagcctttgggagtacagcctgatagggtgttgcagagacctgctacaccactagtataaaaactctgctgtacatggcac

SEQ ID NO: 395 - DNA, 383 bp, Bovine viral diarrhea virus 1
  isolate Carlito, complete genome.1
gtatacgagaattagttaaaactatcgtatacacattgagcattccaaaatgataattggacctagggaacaatccctcccagcgaaggccgaaaagaggctagccatgcccttagtaggactagcaaaatggggggggtagcaacagcggtgagttcgttggatggccgaagccccgagtacggggcagtcgtcagtggttcgacgcctggcgcgacaggcctcgagatgccacgtggacgagggcacgcccacggcacatcttagccagagcgggggtcgctcgggtgaaagtggtcaaacagactactacgaatacagcctgatagggtgctgcagaggcccgctgtaatgctactaaaaatctctgctgtacatggcac

SEQ ID NO: 396 - DNA, 384 bp, Pestivirus type 1
  cytopathic genomic RNA, complete genome.1
gtatacgagaatttgcctaggacctcgtttacaatatgggcaatctaaaattataattaggcctaagggacaaatcctcctcagcgaaggccgaaaagaggctagccatgcccttagtaggactagcaaaataaggggggtagcaacagtggtgagttcgttggatggctgaagccctgagtacagggtagtcgtcagtggttcgacgcttcggaggacaagcctcgagataccacgtggacgagggcatgcccacagcacatcttaacctggacgggggtcgttcaggtgaaaacggtttaaccaaccgctacgaatacagcctgatagggtgctgcagaggcccactgtattgctactgaaaatctctgctgtacatggcac

SEQ ID NO: 397 - DNA, 384 bp, Bovine viral diarrhea virus 1
  isolate SuwaCp, complete genome.1
gtatacgagatttagaaaagtctctcgtatacacattggacataacaaaataacaattaggcctagggaacgaatccctctcagcgaaggccgaaaagaggttaaccatacccttagtaggactagcaaacgagaggggtagcaatggtggtgagttcgttggatggctgaagccctgagtacagggtagtcgtcaatggttcgacacctatggaacgtaggtctcgagatgccatgtggacgagggcatgcccacagcacatcttaactttggcaggggtcgccaaagtgaaagtggcctaaccaaccactacgaacacagcctgatagggtgctgcagaggcccaccttcttgctactaaaaatctctgctgtacatggcac

SEQ ID NO: 398 - DNA, 384 bp, Bovine viral diarrhea virus 1
  isolate 10JJ-SKR, complete genome.1
gtatacaggaattaggaaaagctcctgtatacaaattgggcaattaaaaattgaagattaggcctagggaaagatccctctcagcgaaggccgaaaagaggctagccatgcccttagtaggactagcaaaatgagaggggtagcaacagtggtgagttcattggatggctgaagccctgagtacagggtagtcgtcagtggttcgacacctcggaaagaaggtctcgagatgccacgtggacgagggcatgcccacagcacatcttaacctggacgggggtcgcccaggtaaaagcagtttaactaactgttatggacacagcctgatagggtgctgcagaggcccactgcattgctactaaaaatctctgctgtacatggcac

SEQ ID NO: 399 - DNA, 384 bp, Pasivirus A3
  isolate CS15-4016, complete genome.3R
cctacctcaagcagcagtagcagtagaaaagcagagaagcgctctcaaggtctgcaggttggagaatgagcgtaagaggaagaagggttgaagatatagagaggtgatagcaaggaggaggtgctcaggttaggagaccaatggtagcagggggtaagggtactttccctagttgagatagctatatatggctgggggaggtgctgggattgtttaaagattgtctaaatgtggcgcaagttctgttaatattttacctgacctttaccgtaaaaggaacaaggaagcatgtctttgcattacataacgcatgagtggttttaatctgttaccaattaacagagtacggtcagggttcgttgcggcttcctttgatacgtgggc

SEQ ID NO: 400 - DNA, 385 bp, Bovine viral diarrhea virus
  strain Oregon C24V, complete genome.1
gtatacgagagttagataaaaatactcgtatacacattgggcaattaaaagtaataattaggcctagggaacgaatcctcctccgcgaaggccgaaaagaggctagccatgcccttagtaggactagcatagcgaggggggtagcaacagtggtgagttcgttggatggcttaagccctgagtacagggtagtcgtcagtggttcgacgccttaacatgaaggtctcgagatgccacgtggacgagggcacgcccaaagcacatcttagcccgagcgggggtcgctcggacgaaaacagtttgatcaactgctacgaatacagcctgatagggtgctgcagaggcccactgtattgctactaaaaatctctgctgtacatggcac

SEQ ID NO: 401 - DNA, 385 bp, Bovine viral diarrhea virus 1-SD1
  polyprotein gene, complete cds.1
gtatacgagaactagataaaatactcgtatacatattggacaacagaaaataactattaggcctagggaatgaatccctctcagcgaaggccgaaaggaggctagccatgcccttagtaggactagcataatgaggggggtagcaacagtggtgagttcgttggatggcttaagccctgagtacagggtagtcgtcagtggttcgacgcctcggtataaaggtctcgagatgccacgtggacgagggcacgcccaaagcacatcttaacctgagcgggggtcgcccaggcaaaagcagatcgaccaatctgttacgaatacagcctgatagggtgctgcagaggcccactgtattgctactaaaaatctctgctgtacatggcac

SEQ ID NO: 402 - DNA, 385 bp, Bovine viral diarrhea virus 2
  strain HLJ-10, complete genome.1
gtatacgaaattagctaaagtactcgtatacggattggacgttggcaaacattgaattgacaaggtagggaattttcccctcagcgaaggccgaaaagaggctagccatgcccttagtaggactagctaaaagaggggactagcggtagcagtgagttcattggatggccgaatccctgagtacagggaagtcgtcaatggttcgacactccgtcagtcgaggagtctcgagatgccatgtggacgagggcttgcccacggcacatcttaacccatgtgggggttgcatgggtgaaagcaccattctaggtgttatggacacagcctgatagggtgtagcagagacctgctattctgctagtaaaaactctgctgtacatggcac

SEQ ID NO: 403 - DNA, 385 bp, Atypical porcine pestivirus 1
  isolate AH-GL-2017.04, complete1
atatggggcataatgcatagattggctgcattatgtgtataacatcccaaattgccataggctctgtggtgagtgggggaaaggggttaaccaggcctctagtaccacaggcaccatttaacagggcaactcaaacctgagagagaggtaccgaactcttaagcctcgagtacggggcagacgtcaccgagtagtacacccaacgaccaccacatttaggtgtagggtctactgaggctcgggtggacgtgggcatgcccaaagagaaaacggtgggggacctgggggtcgggtccgccatgcccctcaatggggtagaccttactgcttgatagagtgccggcggatgcctcaggtaagagtataaaatccgttgtttattaac

SEQ ID NO: 404 - DNA, 385 bp, Bovine viral diarrhea virus 2
  clone BV 65 polyprotein gene, partial1
gtatacgagattagctaaagtactcgtatacggattggacgtcgacaaactttgaattggcaacacagggaaccttcccctcggcgaaggccgaaaagaggctagccatgcccttagtaggactagacaaaggaggggactagtggtagcagtgagtccattggatggccgaacccctgagtacaggggagtcgtcaatggttcgacactcctttagtcgaggagtctcgagatgctatgtggacgagggcatgcccacggcacatcttaacccacgcgggggttgcgtgggtgaaagcgccattcgtggcgtcatggacacagcctgatagggtgtagcagagacctgctactccgctagtaaaaactctgctgtacatggcac

SEQ ID NO: 405 - DNA, 386 bp, Bovine viral diarrhea virus 2
  genomic RNA, complete genome, strain:1
gtatacgagattagctaaagtactcgtatacagattggatgttgacaaaatattgaattgacaaggtagggaattttcccctcagcgaaggccgaaaagaggctagccatgcccttagtaggactagcaaaaggaggggactagcggtagcagtgagttcattggatggcctaatccctgagtacagggaagtcgtcaatggttcgacactccatcagttgcggagtctcgagatgccatgtggacgagggcatgcccaaggcacatcttaacctatgcgggggttgcataggcgaaagcaccattcgtggtgttatggacacagcctgatagggtgtagcagagacctgctattccgctagtaaaaactctgctgtacatggcac

SEQ ID NO: 406 - DNA, 386 bp, Bovine viral diarrhea virus 1
  gene for polyprotein, complete cds,1
gtgtatacgagatttagaaaaagctcttgtatacatattgggcaatctaaacaacaatcaggcctagggaattaatcctcctcggcgaaggccgaaaagaggctagccatgcccttagtaggactagcataacgaggggggtagcaacagtggtgagttcgttggatggcttaagccctgagtacagggtagtcgtcagtggttcgacgcctcggaaatagaggtctcgatatgccacgtggacgagggcacgcccaaagcacatcttaacctgagcggggggtcgctcaggtgaaagcggttcaaccaaccgttacggatacagcctgatagggcgctgcagaggcccactgttttgctactaaaaatctctgcttacatggcac

SEQ ID NO: 407 - DNA, 386 bp, Bovine viral diarrhea virus 1
  strain Singer Arg, complete genome.1
gtatacgagaattattcgcccttctcgtatacgtattgggcaattaaaataataattaggcctagggaacaaaagtccccctcagcgaaggccgaaaagaggctagccatgcccttagtaggactagcataaagaggggggtagcagcagtggtgagttcgttggatggcttaagccctgagtacagggtagtcgtcagtggttcgacgccttggaataaaggtctcgagatgccacgtggacgagggcatgcccaaagcacatcttaacctgagcgggggtcgcccaggtaaaagcagttctaaccgactgttacgaatacagcctgatagggtgctgcagaggcccactgttctgctactaaaaatctctgctgtacatggcac

SEQ ID NO: 408 - DNA, 386 bp, Bovine viral diarrhea virus 2
  strain CN10.2015.821, complete1
gtatacgagtactttagctaacctcgtatacagattggatgttgacaaacattgaattggcaaagtagggaacctttcccctcagcgaaggccgaaaagaggctagccatgcccttagtaggactagcaaaaggaggggactagcggtagcagtgagttcattggatggccgaatccctgagtacagggaagtcgtcaatggttcaacactccactaatcgaggagtcttgagatgccatgtggacgagggcatgcccacggcacatcttaacctatgcgggggttgcatgggtgaaagcaccatttgtggtgttatggacacagcctgatagggtgtagcagagacctgctattccgctagtaaaaactctgctgtacatggcac

SEQ ID NO: 409 - DNA, 386 bp, Classical swine fever virus
  isolate IVRI-CSF-BS, complete genome.1
tttgcccgattgtgcatacgaggttagttcattctcgtatgcacaatcgggcaaatggaaacttcaatttggttcagggcctctctccagcgacggccgaactgggctagccatgcccatagtaggactagcaaatggagggactagccgtagtggcgagctccctgggtggtctaagtcctgagtacaggacagtcgtcagtagttcgacgtgagcagaagctcacctcgagatgctatgtggacgagggcgtgcccaagacacaccttaactctagcgggggtcgctagggtgaaatcacaccatgtgatgggagtacgacctgatagggtgctgcagaggcccactattaggctagtataaaaatctctgctgtacatggcac

SEQ ID NO: 410 - DNA, 386 bp, Bovine viral diarrhea virus type 1b
  strain HP-KY-RK13, complete1
gtatacgaggttaggcaagttctcgtatacatattggacactctaaaaaaaaataattaggtctaggggacaaaaatcctccttagcgaaggccgaaaagaggctagccatgcccttagtaggactagcaaaataaggggggtagcaacagtggtgagttcgttggatggctgaagccctgagtacagggtagtcgtcagtggttcgacgctttgaagaacaagcctcgagatgccacgtggacgagggcatgcccacagcacatcttaatctggacgggggtcgttcaggtgaaaacggtttaaccaaccgctacgaatacagcctgatagggtgctgcagaggcccactgtattgctactaaaaatctctgctgttcatggcac

SEQ ID NO: 411 - DNA, 386 bp, Bovine viral diarrhea virus 1
  genomic RNA, complete genome, strain:1
gtatacgagaagatttagctaaaaactctcgtatacaaattgggcattccaaacaacaattaggtctagggaagaatcctcctcagcgaaggccgaaaagaggctagccatgcccttagtaggactagcaaattggggagggtagcagcagtggtgagttcgttggatggctgaagccctgagtacagggtagtcgtcagtggttcgacacctcaaggttgaggtctcgagatgccacgtggacgagggcatgcccacagcacatcctagtctgggcaggggtcgctcagatgaaagcggttgagtcaaccgttacggacacagcctgatagggtgctgcagaggcccactgtgttgctactaaaaatctctgctgtacatggcac

SEQ ID NO: 412 - DNA, 386 bp, Porcine enterovirus 8
  isolate Po 5116 polyprotein gene, partial1
ccttccaaatcggatggactactggacttgaaactatggaaagtaaattggtgagattttggatacacttgaacggtagtagcgtggcgagctatggaaaaatcgcaattgtcgatagccatgtcagtgacgcgcttcggcgtgctcctttggtgattcggcgactggttacaggagagtagacagtgagctatgggcaaacccctacagtatttcttagggggaatgtgcaattgagacttgacgagcttctctcagagatgtggcgcatgctcttggcattaccatagtgagcttccaggttgggaaacctggactgggtctatactacctgatagggtcgcggctggccgcctgtaactagtatagtcagttgaaaccccccc

SEQ ID NO: 413 - DNA, 387 bp, GB virus C
  gene for polyprotein, complete cds,isolate: HGV-GA128.1
tagccactataggtgggtcttaaggggaggttatggtccctctcgcgcttatagagagaaagcgcacggtccacaggtgttggccctaccggtgtaataagggcccggcgctaggcacgccgttaaaccgagaccgttacccccctgagcaaacgacgcccacgtacggcctacgtcgcccttcaatgtctctcttgaccaataggcgatgccggcgagttgacaaaggccagtgggggccgggcggcaggggaaggacccctgtcgctgctcttcccgggggggcgggaaatgcatggggccacccagctccgcggcggcctacagccggggtagcccaagagccttcgggtgagggcgggtggcatttttcttccttaactgatc

SEQ ID NO: 414 - DNA, 387 bp, Bovine viral diarrhea virus 1
  gene for polyprotein, complete cds,1
cgtatacgagagttagacaaaatgctcgtatacacattgggcaaactaaataataataattgggcctagggtactaatccccctctgcgaaggccgaagagaggctagccatgcccatagtaggactagcataatgaggggggtagcaacagtggtgagttcgttggatggcttaagccctgagtacagggtagtcgtcagtggttcgacgccttagtataaaggtctcgagatgccacgtggacgagggcacgcccaaagcacatcttaacctgagcgggggtcgctcaggcgaaagcagtttaaccaactgttacgaatacagcctgatagggtgctgcagaggcccactgtactgctactaaaaatctctgctgtacatggcac

SEQ ID NO: 415 - DNA, 387 bp, Bovine viral diarrhea virus 2
  genomic RNA, complete genome, strain:1
gtatacgaggttagttaaagttatcgtatacagattggacgtttacaaaacagtgaattggcaaaatagggaaccttcccctcagcgaaggccgaaaagaggctagccatgcccttagtaggactagcaaaaagaggggactagcggtagcagtgagttcattggatggccgaatccctgagtacagggaagtcgtcaatggttcgacgctctagcaattgcagagcctcgagatgccatgtggacgagggcatgcccacggcacaccttaacctatgcgggggttgcgtaggtgaaagcaccattttgtggtgttatgaacacagcctgatagggcgtagcagagacctgctactccgctagtaaaaactctgctgtacatggcac

SEQ ID NO: 416 - DNA, 387 bp, Bovine viral diarrhea virus 2
  isolate JZ05-1, complete genome.1
gtatacgagattagctaaagtactcgtatacggattggacgttgacaaaatattgaattgaaaatgtagggaatcttcccctcagcgaaggccgaaaagaggctaaccacgcccttagtaggactagcaaaaggaggggactagcggtagcagtgagttcattggatggccgaacccctgagtacaggggagtcgtcaatggttcgacactccttcagttaaggagtctcgagatgccatgtggacgagggcatgcccacggcacatcttaacccatgcgggggctgcatgggtgaaagcgccattcgtggcgttatggacacagcctgatagggtgtagcagagacctgctatcccgctagtaaaaaactctgctgtacatggcgc

SEQ ID NO: 417 - DNA, 387 bp, Bovine viral diarrhea virus 1
  genomic RNA, complete genome, strain:1
cgtatacgaggatttaggaaaaactctcgtatacagattgggcactcaaaaataacaattaggcctagggatcaaatcctcctcagcgaaggccgaaaagaggctagccatgcccttagtaggactagcaaattgaggggggtagcaacagtggtgagttcgttggatggctgaagccctgagtacagggtagtcgtcagtggttcgacacctacggcgtgtaggtctcgagatgccacgtggacgagggcatgcccacagcacatcttagcctgggcgggggtcgctcaggtgaaagcggtttaaccaactgctacgaatacagcctgatagggtgctgcaggggcccactggactgctactaaaaatctctgctgtacatggcac

SEQ ID NO: 418 - DNA, 387 bp, California sea lion sapelovirus 1
  isolate 1162 polyprotein gene,1
ccccaatccactaaccttttccccctcctttaatcggactgatatttgtgttttgacgcttgttttccttttgcggatgtcggttgcgtggctggccaccacgggaaaaatggcaattgtggattgatgggtctacacattctcaccgaacgccttgtgttattaggggagtctaagtgtccatcatgaagcgagtgtactggtaagagaggagacctagctaggggcaatgggacggcgttgcctatccctaattagccatcgagatttctctggcgattacccagtgatggtcgggttgtcggggggcaacctgcttagctccttactgcctgatagggtcgcggctggccgtatcagtacactatagtcagttgatgttcgaat

SEQ ID NO: 419 - DNA, 387 bp, Norway rat rosavirus
  isolate NrRV/NYC-A15 polyprotein gene, partial1
taaggtagcagatgatttagtgaaaagctttggattgtttggagttttgtagcgatgctagtagtgtgtgtggacctccccacgtggtaacacgtgccccacaggccaaaagccaaggtgttgaaagcacccctactagtcccagaccctcccatctgggaactcctctcatgaaaaaccctagtaactaatgatttggcttctcatcaacctctctagtcaaggctgaaggatgcccggaaggtacccgcaggtaacgataagctcactgtggatctgatccggggctctggtgcgaccgactgtccggcgtagcagggttaaaaaacgtctaggcccttctaccccaagggattggggtttccccaatcattttagaagttcact

SEQ ID NO: 420 - DNA, 388 bp, GB virus C
  gene for polyprotein, complete cds, isolate: HGV-BL230.1
tagccactattggtgggtcttaaggggtggtcaaggtccctctggcgcttgtggcgaaaaagcgcacggtccacaggtgttggccctaccggtgggaataagggcccgacatcaggctcgtcgttaaaccgagcccattatccccctgggcaaacgacgcccacgtacggtccacgtcgcccttcaatgtctctcttgaccaataggcgatgccggcgaattgacaaggaccaatgggggccgggcgtcaggaaatggactcctgccgctgcccttcccgggggagtgggaaatgcatggggccacccagctccgcggcggcctgcagccggggtagcccaagagccttcgggtgagggcgggtggcatttttcttcctgtaccgatc

SEQ ID NO: 421 - DNA, 388 bp, Bovine viral diarrhea virus genotype 2
  strain 1373 polyprotein1
gtatacgagattagctaaagtactcgtatatggattggacgtcaacaaatttttaattggcaacgtagggaaccttcccctcagcgaaggccgaaaagaggctagccatgccctttagtaggactagcaaaagtagggggactagcggtagcagtgagttcgttggatggccgaacccctgagtacaggggagtcgtcaatggttcgacactccattagtcgaggagtctcgagatgccatgtggacgagggcatgcccacggcacatcttaacccatgcgggggttgcatgggtgaaagcgctaatcgtggcgttatggacacagcctgatagggtgtagcagagacctgctattccgctagtaaaaaactctgctgtacatggcac

SEQ ID NO: 422 - DNA, 388 bp, Bovine viral diarrhea virus 1
  isolate SD0803, complete genome.1
acatggggtatacgagatttagatcaatctctcgtatacacattgggctatcaaaaaagaaaattaggcctagggaacaatcctcctcagcgaaggccgaaaagaggctagccatgcccttagtaggactagcaaattggggggggtagcaacagtggtgagcttgttggatggctgaagccctgagtacagggtagtcgtcagtggttcgacgccagagatgaggcctcgagatgccacgtggacgagggcatgcccacagcacatcttaatctgggcgggggtcgctcagacgaaagcggttgtaccaaccgttacaagcacagcctgatagggtgctgcagaggcccactgcactgctactaaaaatctctgctgtacatggcac

SEQ ID NO: 423 - DNA, 389 bp, Hepatitis G virus
  gene for polyprotein, complete cds.1
tagccactataggtgggtcttaagggtgggtcaaggcacctcttactcctgcggcgggacagcgcacggtccacaggtgatggccctaccggtgtgaataagggcccgacgtcaggctcgtcgttaaaccgagcccgttacccacctgggcaaacgacgcccacgtacggtccacgtcgccctacaatgtctctcttgaccaataggctatgccggcgagttgacaaggaccagtgggggccgggcgttatggggaaagaccccctgcgctgcccttcccggtggggcgggaaatgcatggggccacccagctccgcgggggcctgcacccggggtagcccaagaaccttccggtgaaggcgggtggcatttttctttcctgactaatc

SEQ ID NO: 424 - DNA, 390 bp, Bovine viral diarrhea virus 1
  isolate SD-15, complete genome.1
acatggggtatacgagatttagctaaaactctcgtatacatattggacattccaaacaataattaggcatagggaaaatcctcctcagcgaaggccgaaaagaggctagccatgcccttagtaggactagcaaattgaggggggtagcagcagtggcgagttcattggatggctgaagccctgagtacagggtagtcgtcagtggttcgacgccttaggatctaaggcctcgagatgccacgtggacgagggcacgcccacagcacatcctaatccgggcgggggtcgctcggatgaaagcggttgtaataaaccgttatggacacggcctgatagggcgctgcaggggcccactgtgttgctactaaaaatctctgctgtacatggcac

SEQ ID NO: 425 - DNA, 391 bp, Bovine viral diarrhea virus 3
  isolate HN1507, complete genome.1
gtatacgcccggttagctcatgtcggcgtatatgattgggtatcccaaattaatgatttggtttagggactaaattcccctagcgaaggccgaaataggttaaccataccttcagtaggacgagcataatgggggactagtggtagcagtgagctccttggattaccgaagccccgggtacagggtcgtcgtcaataaggttcgacgcatcaacgagtggatgcctcgagatgccatgtggacgagggcgtgcccacggtatgtcttaacccaagcgggggccgcttgggtgaaagatggtcgattatgtggccctttgggagtacagcctgatagggtgttgcagagacctgctatatcactagtataaaaactctgctgtacatggcac

SEQ ID NO: 426 - DNA, 391 bp, Bovine viral diarrhea virus 3
  isolate LV168-36/16RN, complete1
gttgggtgtgtttgggccgggtagctcatgtcggcgtatatgattgggtatcccaaattaataatttggtttagggactaactcccctagcgaaggccgaaatgggttaaccataccttcagtaggacgagcgtaatgggggactagtggtagcagtgagctccttggattaccgaagccccgagtacggggtagtcgtcaatggttcgacgcatcaaggaatgcctcgagatgccatgtggacgagggcgtgcccacggtgaatcttaactcaagcgggggccgcttgggtgaaagagggtcattatatggctctttgggagtacagcctgatagggtgttgcagagacctgctacattactagtataaaaactctgctgtacatggcac

SEQ ID NO: 427 - DNA, 391 bp, Bat pestivirus
  BtSk-PestV-1/GX2017 polyprotein gene, complete cds.1
tgcataaccctgattgtaattggctgggttatgcatgtgagaacgcaaaattttttaaattatgttaccggctttgaggttggcggaccagagttaaccaggctctcagtacgacaccctcctaaacaaagtcggaactgctgactaggagactatgcactcagcactaagcccggagtaccgggcattctactacagctctgcactcaacgacggctcttgaggcctagagtccaggatggctgtgtaagtagaggacatgtccaagtgtgaggtgtaatccggtgggggttgccggatttgctactggtagaccagtagtcatagactgcctgatagggtcccggcggacggcctaggcttagcagtataatagtccgttgtattcaac

SEQ ID NO: 428 - DNA, 392 bp, Picornaviridae sp.
  isolate zftegr01hep3nc genomic sequence.1
taactccttggctagcaaggagctgtggccgccaaaagtggtgatacactgactaatactctacttgggtacagtgagttggtccctttggaaagtcacctgatgatctttcaattggggtaggctacgggtgaaaccccttctccctccatttgttatacaaatgtggagtgacaacgctaaggccctggatagaaatgagttctttatggacaagaatttctcaacagggggagcaccggtgtatgtctttgaatgcgtcttgtgactgaaaaaggagcaggcttattgtgttcacatagagttaaggtgtaccctatgagtttagggctactcaggggcatgttaggttttaaaatgctcatttattgttttctatgagttgagagaag

SEQ ID NO: 429 - DNA, 393 bp, Pasivirus A3
  isolate CS15-4016, complete genome.2R
agcgaagcgatcggtgtctcgggcactgtgacgataagcaaactcagcatcagggacgaggctggaggaagaacctacttatctaagcgccccgtctgagcagcagcgtcgaaaatcaacttcgtcttcgtcgtgaactgcgacgactggttgtgcgaacggcaacgatcctagtcgtagtgttggttctcgcccgtcgagacgcgcccccgcggactcggcgcctgctgacgcgtcgtctccgacgcgacctagcagcacccaatcctaagagtgtgcgaagggtcagagctccgcgtcggagcccaactccccgcataccgtgacgggagatacgtcgtggtctcatggcgccccaaccgcggttgtcgctgggtgagatcaaaatggaca

SEQ ID NO: 430 - DNA, 393 bp, Kunsagivirus B
  clone Bat/CAM/KuV-P2/2013 polyprotein gene, complete1
gattttctggttatcccttttggacttggtaggggcccacgtgcccacccacctctgtgtgtgttgatttctaatcgatgcctggcagtggcggccacctctccttactggtaaacctccggtgagtgaagttgtcaagctacaggtaccgtgcaggatgaaatgcgcacatgtgaacaaactaggagtcatacaccgggtcaaactctggaaacggagtccgggactctgaccttggttgggtgagctcgaggcatcacattgatggacgcgattcgctatccttccctagtaggaccttgtggtgtacccctggttgggaatccagggctggtcgggtgcagggtgacagcctgttctccacctcaaccattgtaggagaaatcaacccct

SEQ ID NO: 431 - DNA, 395 bp, Kobuvirus sp.
  strain 16806x8 polyprotein gene, partial cds.1
accacgtctttcctccagatcgacagtcctgctgtgtgaattcccattgcgcacttagtggtgtcactgtgcgctcccaatctcggccgcggagtgctgttccccaagccaaacccctggcccttcactatgtgcctggcaagcatatctgagaaggtgttccgctgtggctgccagcctggtaacaggtgccccagtgtgcgtaaccttcttccgtcttcggacggtagtgattggttaagatttggtgtaaggttcatgtgccaacgccctgtgcgggatgaaacctctactgccctaggaatgccaggcaggtaccccacccccgggtgggatctgagcctgggctaattgtctacgggtagtttcatttccaattcctttatgtcggagtc

SEQ ID NO: 432 - DNA, 396 bp, Border disease virus
  isolate TO_121_04 genome assembly, complete1
ctctgcagatatcaggggtgtatacgaaagtagctcaagttcgtatacaaattgactatgaccaaaatagtattcggcgtagggacaccctccagcgaaggccgaacggggttaaccatacccttagtaggactagcagacggagggactagccatcatggtgagcttcctgaggggtctaagtcctgagtacaggacagtcgtcaatagttcgacacgtgcgagtcgcacgtctcgagatgctatgtggacgagggcatgcccaagacactttctctagcctgggcgggggtcgcccaggtgaaagcacctgataggtgttgggagtacagcctgatagggtgctgcagaggcccatgcataggctagtataaaaatctctgctgtacatggcac

SEQ ID NO: 433 - DNA, 396 bp, Porcine teschovirus 15
  JPN/Ishi-Ka1/2015/G new genomic RNA, nearly1
gataagtgatagtccttggaagctaggtacttgttacgctagttttggattatcttgtgcccaacaattgtctttggacacttgttgtgtttaaacacagaaatctttgattattggttgtgaatttaatggattcttcccttgaaagacttgccttggcgcgggctagagcgcaattgtcaccaggtattgcaccaacggtggcgacagggtacagaagagcaagtactcctgactgggcaatgggactgcattgcatatccctaggcatctattgagatttctctggagcccaccagcatggagttcctgtatgggaatgcaggactggacttgtgctgcctgacagggtcgcggctggccgtctgtactttgtatagtcagttgaaactcatt

SEQ ID NO: 434 - DNA, 399 bp, Porcine pestivirus
  isolate Bungowannah, complete genome.1
tacgcggggtataacgacagtagttcaagtgtcgttatgcatcattggccataacaaattatctaatttggaatagggacctgcgacctgtacgaaggccgagcgtcggtagccattccgactagtaggactagtacaaataggtcaactggttgagcaggtgagtgtgctgcagcggctaagcggtgagtacaccgtattcgtcaacaggtgctactggaaaggatcacccactagcgatgcctgtgtggacgaggacatgtccaagccaatgttatcagtagcgggggtcgttactgagaaagctgcccagaatgggtagttgcacatacagtctgataggatgccggcggatgccctgtattttgaccagtataaatattatccgttgtaaagcat

SEQ ID NO: 435 - DNA, 399 bp, Pasivirus A
  isolate SPaV-A_GER_L00721_2014 genome assembly,1
attttctggccgtgtagctgcttttgaccagtggctctgggttacttagccaaatcccccttccttcacccttttaaatttgatggtctgtgttgtttgttttgtcttgtctaaataatatataagatccttcccgccgatacagacctcgacagtctggtgtaggagggttggtgttattaatttgccccagaagagtgaccgtgacacatagaaaccatgagtacatgtgtatccgtggaggatcgcccgggactggattccatatcccattgccatcccaacaagcggagggtatacccactatgtgcgcgtttgcagtgggaatctgcaaatttagtcatactgcctgatagggtgtgggcctgcactctggggtactcaggctgttcatataat

SEQ ID NO: 436 - DNA, 400 bp, GB virus C
  gene for polyprotein, complete cds, isolate: G13HC.1
ggtcatcttggtagccactataggtgggtcttaagggtgggtcaaggtccctctggcgcttgtggcgagaaagcgcacggtccacaggtgttggccctaccggtgtgaataagggcccgacgtcaggctcgtcgttaaaccgagcccatttcccacctgggcaaacgacgtccacgtacggtccacgtcgcccttcaatgtctctcttgaccaataggctttgccggcgagttgacaaggaccagtgggggccgggcagcaggggaaggacccctgttgtcgcccttcccggtggggatgggaaatgcatggggccacccagctccgcggcggcctgcagccggggtagcccaagaaccttcgggtgagggcgggtggcatttttcttcctataccgatc

SEQ ID NO: 437 - DNA, 401 bp, Human rhinovirus A
  strain HRV-A33_p1152_sR1114_2009 polyprotein1
tttgatcgttatccgcaaaacaactacgcaaagcctagtatcatcttcaaagatatgtggttggtcgctccgctataaacccaatagcagacctggcagatgaggctagaaattccccactggcgacagtgttctagcctgcgtggctgcctgcgtaccctgcatgggtacgaagccatatattggacaaggtgtgaagagccccgtgtgcttgttttgagtcctccggcccctgaatgtggctaaccttaaccctgcagctggtgtgtgcaatccagcacatggccagtcgtaatgagtaattgcgggatgggaccaactactttgggtgtccgtgtttcctgttttacctttatatttgcttatggtgacaatatatatataacatatatattggcatc

SEQ ID NO: 438 - DNA, 402 bp, Human pegivirus
  isolate JD2B8C, complete genome.1
tggtcaccttggtagccactataggtgggtcttaagagaaggttaagattcctcttgtgcctgcggcgagaccgcgcacggtccacaggtgttggccctaccggtgtgaataagggcccgacgtcaggctcgtcgttaaaccgagcccatttcccgcctgggcaaacgacgcccacgtacggtccacgtcgcccttttaatgtctctcttgaccaataggttcatccggcgagttgacaaggaccagtgggggccgggggtcacagggatggaccctgggccctgcccttcccggcggggtggggaaagcatggggccacccagctccgcggcggcctgcagccggggtagcccaagaaccttcgggtgagggcgggtggcatttttcttcctataccgatc

SEQ ID NO: 439 - DNA, 403 bp, Pasivirus A
  isolate SPaV-A_GER_L01061-K07_15-03_2015 genome1
gcggctggatattctggccgtgcaactgcttttgaccagtggctctgggtaacttagccaaagtgtccttctccctttccctattatatgttttatggctttgtctggtcttgtttagtttatatataagatcctttccgccgatatagacctcgacagtctagtgtaggaggattggtgatattaatttgccccagaagagtgaccgtgacacatagaaaccatgagtacatgtgtatccgtggaggatcgcccgggactggattccatatcccattgccatcccaacaagcggagggtatacccactatgtgcacgtctgcagtgggagtctgcagatttagtcatactgcctgatagggtgtgggcctgcactctggggtactcaggctgtttatataat

SEQ ID NO: 440 - DNA, 404 bp, Pasivirus A
  isolate SPaV-A_GER_L00799-K11_14-01_2014 genome1
gctggactttctggctgcgcaactgcttttaaccagtggctctgggttacttagccaaaaccccctttccccgtaccctagtttgtgtgtgtattattattttgttgttgttttgtaaatttttatataagatcctttccgccgatatagacctcgacagtctagtgtaggaggattggtgatattaatatgccccagaagagtgaccgtgacacatagaaaccatgagtacatgtgtatccgtggaggatcgcccgggactggattccatatcccattgccatcccaacaaacggagggtatacccgctatgtgcgcgtctacagtgggaatctgtagatttagtcatactgcctgatagggtgtgggcctgcactctggggtactcaggctgtttatataat

SEQ ID NO: 441 - DNA, 405 bp, Pacific black duck aalivirus
  isolate PBDAaV/4768nt/PBD05.18-AU-20181
gctcttccctccacctcctttcaacgtctggcccacgaaacgggccacttttcaatcttaaataactatcccttttcttgttttgactttccggttaagaataatatggatcacacaattggattttctctaaggataatggataggatactttcgggataccactccctttctgtgctaacacaaattctaattctctacatctcttatatgctcgaagaggtggtgctgaaatattgcaagccattcttgcatgtaggtggtttagactcaagatgaatgttgtgttactcaagacaagtgtagctatcaccatggtattggtagcgtgaatcggattaccggtagtagcgcaatcttccgccatggtgctctagtgactagaggacaacgacatggcattgg

SEQ ID NO: 442 - DNA, 405 bp, Enterovirus sp.
  isolate CU106 polyprotein gene, partial cds.1
caaaaacctcaaagatcgttatccgctcattaactacgcaaagcctagtaacatcttggatgtggtaaagttggtcgctccctgcattcccagcagtagacctggcagatgaggctggatgttccccactggcgacagtgatccagcctgcgtggctgcctgctcacccaaacgggtgagaagccttattactgacatggtgtgaagagccccgtgtgcttaatgtgagtcctccggcccctgaatgtggctaaccttaaccctgtagccgttgctcataatccaatgagtatgcggtcgtaatgcgcaagtacgggatgggaccaactactttgggtgtccgtgtttcttatttttctttatctgcgttatatggtgacaatttatagaatatagattgtcatc

SEQ ID NO: 443 - DNA, 405 bp, Rhinovirus B
  strain 20692_48_HRV-B polyprotein gene, partial cds.1
tgtgcttgtaacgccatgggggaaatcacttgatcgaacgcctagtaccatcatgtctttgactaggcgttcgatcaagtgatttcccccatcactagtttggtcgatgaggctaggaattccccacgggcgaccgtgtcctagcctgcgtggcggccaacccagcagttgctgggacgccttttttagggacatggtgcgaagactcgcatgtgcttggttgtgactcctccggcccctgaatgcggctaaccttaaccctggagccttgtgctacaatccagtagcattaaggtcgtaatgagtaattccgggatgggaccgactactttgggtgtccgtgtttcctgttttttccaaatgttttcttatggtcacagcatatagcatatatatactgtgatc

SEQ ID NO: 444 - DNA, 407 bp, Picornaviridae sp.
  isolate gbt104pic2 genomic sequence.1
ccactgtatatacatttaatcatttccccttctttttggtctctcttgtacataaggataaaacccctctaacaaagcctgttcttcagactattaagtatgacaatatattacattatctaactacacatgaaggccgtcgtgctttctcacgccttcccacctacttccatcttcacagacattgggtagaggcactttatcctgaaggactccagcccacatccactcatttatcttctgagactttccattgtaaatatctttgcggccattttcttcagacgtgtgagtggcatgcaaacgttcaagtccctccttttattttagttcgtaggcaacttatttataatattctttgcaaattgaatcttcttgatagtcttcctttcttcctttcagtggca

SEQ ID NO: 445 - DNA, 407 bp, Hepatovirus sp.
  isolate HepV-bat3206/Hipposideros_armiger/20111
ggataccaatggaacgaccgctgcgcccggcggggttaacttgttgattagcaacaagctgtagtttctaaaagtcctgacaccataggtccacgtcccgacctttggcattttaacttcattttggtgaagtccattgatcttctaggaggagtaggctatgggtgaaactcctcatgctagtacctatattaggagatgcattgtgtaggtgaaggtttccggtagaggtgagttttacgacgcaacctctcaacggatgtgggcccatctcacacactagatgctttggatgaatccaatctgagggtgtcattgttagggatctggatactaggtgccctcccgagaggtcgtaggggtaatcaggggcatataggtttccacacattaaatgttattatgtt

SEQ ID NO: 446 - DNA, 410 bp, Bat picornavirus 1
  strain NC16A, complete genome.1
gaaacccgtatacaccggaccttttctcccctccctctccacttacctttttcccctcttcggcatgaaacaaggattattcaagtggaaacgcgatttaatatgcggctggccaccgcggaataacggcaattgtgtatctgctggaagccaagcctgcctagccgatagcccttgaccgggtgtgtaggatagcccaggaaccagcaatacgcgacaggttatggtagagtagatacctagccaggggcaatgggactgcattgcatatccctaatgaaccattgagatttctctggtcattacccggtgatggttactagaggggggcctctagtactagatctatactgcctgatagggtcgcggctggccgaccatgacctgtatagtcagttgatttgagcaat

SEQ ID NO: 447 - DNA, 410 bp, Enterovirus sp.
  isolate CU42 polyprotein gene, partial cds.1
ttgaagctgtagcgttcgttacccgcacacgtactgcgtgacggctagtagcatcttgcattttcctttaggtgtttcgctcattgtggttaccccaccacatagatcagggcaatggggctacacaatccccactggcgacagtggtgtagcccgcgtggtgccccgcccaggctttgcctgggacgccttaggaaagacagggtgtgaagaccttaatgcgctacgtgtgagtcctccggcccctgaatgcggctaatcctaaccccgtagccatggtgcgcaatccagcgcatgtgtggtcgtaacgagcaattacgggatggaaccgactactttgggtgtccgtgtttcactttttatttgaaattgtctcatggttacagatttgtgtatacagatttgtaatc

SEQ ID NO: 448 - DNA, 411 bp, GB virus C
  genomic RNA, complete genome, strain: F1029.1
ccgacgcctatcttaagtgagacgtaatggccccgcgccgaactggcgaccggccaaaaggtggtggatgggtgatgacagggttggtaggtcgtaaatcccggtcatcctggtagccactataggtgggtcttaaagggaggctacggtccctcttgcgcttatggcgagaaagcgcacggtccacaggtgttggccctaccggtgtgaataagggcccggcgctaggcacgccgttaaaccgagcccgtcatccccctgggcaaacgacgcccatgtacggtccacgtcgcccttcaatgtctctcttgtaccaataggttttgccggcgttgttgacaaggaccagtgggggctgggcggtaggggaaggacccctgccgctgcccttcccggtggggtgggaaatgc

SEQ ID NO: 449 - DNA, 412 bp, Pasivirus A3
  complete genome.2
ttagtcatactcaaggtgtaaatattcatttgatctttgtacagtttttataccatatttacattattataggttactggttgctacatcctggtcatagtcacatcatcatcataggtctaggtcacaattaggtttgtcagatactcaagacgacgtggaatctctcttgtcacctgaatcctatcctttactgtcctatcctatcctatactgcctttgttttgttatccaaagtcagcaagtgccatctttctccaagtgcaatgtcatctgcctgtaatcccaaaagctggtgtcatccttgtcagtagaacagtcaaactaagcctttgaaaagaaagcctcacacggaaaccttgtatgtatacctcgtgaaaaagctttgaactgccacgacattgacgcctgc

SEQ ID NO: 450 - DNA, 413 bp, Sapelovirus A
  strain ISU-SHIC polyprotein mRNA, complete cds.1
gttgtatcccccataccttaccctcccttccacacaggacggacaaatggacttggacttacggcaagaacatatggtatggcttttggatacggatgaatggcagtagcgtggcgagctatggaaaaatcgcaattgtcgatagccatgttagtgacgcgctccggcgtgctcctttggtgattcggcgactggttacaggagagtaggcagtgaactatgggcaaacctctgcagtattactcagggggaatgtgcaattgagacttgacgagcgtctccttggagatgtggcgcatgctcttggcattaccatagtgagcttccaggttgggaaacctggactaggcctatactacctgatagggtcgcggctggccgcctgtaactagtatagtcagttgaaacccccc

SEQ ID NO: 451 - DNA, 414 bp, Avian encephalomyelitis virus
  isolate 204C, complete genome.1
ggagcgcacggtatatatgtgctcccgcatggcaggggcgtgctaccttgccccttgacgcatggtatgcgtcaaactgattttggatttgtcttaaggattagtcgctttgtgccgaaaatctctttgcgtttcacagaaccatcctaaccatggatgtagtatgggaggcgtgtataggggtgagtaggatctctcatagagggataggcatgccattcaaatccggggagtactccggctctgacattgggacatttgatttaaccggacctggttcagtatccgggttgtcctgtattgtcacggtgtatccgtcttggcatgttgaaaaggtatctttgggtaatcccttcctactgcctgatagggtggcgtgcccggccatgagagattaagggtagcattttaacc

SEQ ID NO: 452 - DNA, 415 bp, Teschovirus A
  strain CHN-NP2-2016, complete genome.1
cccctttgaacttgtaactgataagtgatagtccttggaagctaggcacttgctgcgctagttttggattatcttgtgcccaacactagtcttcggactcttgttgtgtttaaacacagaaattttgttatctggttatgaattcattggatcaatccttctgaaagacctgctctggcgcgagcgaaagcgcaattgtcaccaggtattgcaccaatggtggcgacagggtacagaagagcaagtactcctgactgggcaatgggactgcgttgcatatccctaggcacctattgagattcctctggggcccaccagcatggagttcctgtatgggaatgcaggactggacttgtgctgcctgacagggtcgcggctggccgtctgtactttgtatagtcagttgaaactcacc

SEQ ID NO: 453 - DNA, 415 bp, Porcine teschovirus
  strain HuN-1, complete genome.1
ctccctttgaatttgtaactgataagtgatgatccttggaagctaggtacttgttacgctagttttggattgtcttgtgcccaacactagtcttcggactcttgttgtgtttaaacacagaaatctgattgtctggttgtggatttattggattaaccctttgaaagacctgctctggcgcgagctaaagcgcaattgtcaccgggtactgcaccaatggtggcgacagggtacagaagagcaagtactcctgactgggcaatgggactgcgttgcatatccctaggcacctattgagatttctctggggcccaccagcatggagttcctgtatgggaatgcaggactggacttgtgctgcctgacagggtcgcggctggccgtctgtactttgtatagtcagttgaaactcatc

SEQ ID NO: 454 - DNA, 415 bp, Human rhinovirus B97
  strain SCH-105 polyprotein gene, complete cds.1
ggttgtacccacgaccaaaagcctttaaccgttacccgccaatcaactacgtaacggctagtaccatcatgtttttaatctggtgttcgatcaggtggtatcccccactagtctggtcgatgaggctaggaattccccacgggtaaccgtgtcctagcctgcgtggcggccagcccagcttatgctgggacgcctttttaaagacatggtgtgaagacccgcatgtgcttgattgtgagtcctccggcccctgaatgcggctaaccctaaccccggagcccagcaacataatccaatgttgtttgggtcgtaatgagtaattctgggatgggaccgactactttgggtgtccgtgtttccttttattcttatattgtcttatggtcacagcatatatatcatatatactgtgatc

SEQ ID NO: 455 - DNA, 416 bp, Porcine teschovirus 15
  JPN/Ishi-Ta1/2016/G new genomic RNA, nearly1
cttccttttaattcgtaactgataagtgatagtccttggaagctaggtatttgttacgctagttttggattatcttgtgcccaacatttgttttcgaacatatgttgtgtttaaacacagaaatctagtttctttggttatgagtttaatggaatatccttttgaaagacttgccttggcgcgggctagagcgcaattgtcaccaggtattgcaccaatggtggcgacagggtacagaagagcaagtactcctgactgggtaatgggactgcattgcatatccctaggcatctattgagatttctctggagcccaccagcatggagttcctgtatgggaatgcaggactggacttgtgctgcctgacagggtcgcggctggccgtctgtactttgtatagtcagttgaaactcatt

SEQ ID NO: 456 - DNA, 419 bp, Bat picornavirus 2
  strain MH9F, complete genome.1
gggttttacgaaacccgtatacaccagaccttttctcccctccccctccacctaccttttccccctctttggaccgaaacaaggacacgtaagtggaaacgcgattttatatgtggttggccaccacggaataacggcaattgtctacatgtgggaagtgcaacctccctagccgataacccctgaccgggtgtgtaggataggaaaggtgcccactgtgggcgacaggttatggtagagtggatacctagccaggggcaatgggactgctttgcatatccctaatgaagtattgagatttctctgctcattacccggtgatggttgtgtggggggggccccatacactagatccatactgcctgatagggtcgcggctggccgaccataacctgtatagtcagttgaattcagccaag

SEQ ID NO: 457 - DNA, 419 bp, Sapelovirus-like porcine picornavirus Japan
  Pig/Isi-Im1/JPN/20151
tattacggtaccggtatatcttagtccatttcccccttccctctccacttaccttttccccctcttgtgacggatacttttggttttgactgtatgctagaaaaccctctgatatctggatggcctccagggaataaaggcaattgtggatcgctggtattgggctctgtcggggaaagtaggttaaccataccactagtaccagtctgagcaccccagtgtgaagcgacagtacatagtagagttgggagtgaggcttgggaaatgggactgcattgcatatccctagtgacctattgagatttctctgggcaccaccttgctgagcttaccaggggggggcccctggtactggcccattactgcctgatagggtcgcggctggccgactgtgtattgtatagtcagttgaatttaac

SEQ ID NO: 458 - DNA, 419 bp, Porcine enterovirus 8
  isolate 16-S-X polyprotein gene, partial cds.1
cttaaggtggttgtatcccctaccccatcctcccctccaaacaggacggacaatcggacctgacatctggcgagaagaattggaatggtatttggacacacttgaatggcagtagcgtggcgagctatggaaaaatcgcaattgtcgatagccatgttagtgacgcgcttcggcgtgctcctttggtgattcggcgactggttacaggagagtagacagtgagctatgggcaaacccctacagtgttacttagggggaatgtgcaattgagacttgacgagcgtctcgtagagatgtggcgcatgctcttggcattaccatagtgagcttccaggttgggaaacctggactgggtctatactacctgatagggtcgcggctggccgcctgtaactagtatagtcagttgaaaccccccc

SEQ ID NO: 459 - DNA, 420 bp, GB virus C
  isolate KY117, complete genome.1
gttggtaggtcgtaaatcccggtcatcttggtagccactataggtgggtcttaagggtgggtcaaggttcctcttacgcctgtggcgggacagcgcacggtccacaggtgttggccctaccggtgtgaataagggcccgacgtcgggctcgtcgttaaaccgagaccattacccgcctgggcaaacgacgcccacgtacggtccacgtcgcccttcaatgtctctcttgaccaataggctttgccggcgagttgacaaggaccagtgggggccgggtgcagggggaaggaccccctgtactgcccattccggcggggtgggaaatgcatggggccacccagctccgcggcggcctgcagccggggtagcccaagaatccctcgggtgagggcgggtggcatttttctttctgtaccaatc

SEQ ID NO: 460 - DNA, 420 bp, Bovine kobuvirus
  polyprotein gene, complete cds.1
cccggtggtttgatggtagctctcttatggttctgccctggcaaggctatagagtactgtgatccgctgcggacgccatcctggtaacaggacccccagtgtgcgcaacagtatgctcacggttcgccgtgtccaccatgactggaacactgctttcatgaaacagtgtgtgtccaatccctgtgatcagtatcaaccacaccacctaggaatgctaggaaggtaccccaattcgttgggatctgatcctaggctaattgtctacggtggtgctcctttttattttcacttcacttctctggtcacaactgcttgattctgtgtttgctgcttcctccgctctcactgccattctcaagtgttcacactgtccaagttcctttggttgatctcttccacttgccactgtcaactcttgtc

SEQ ID NO: 461 - DNA, 421 bp, Porcine teschovirus
  strain wild boar/WB2C-TV/2011/HUN, complete1
ccccccctcctttgaatttgtaactggtaagtgataatccttggaagctaggtacttgttacgctagttttggattgtcttgtgcccaacattggtcttcggacttctgttgtgtttaaacacagaaattttaacacctgactatgaattcaatggaccaccccttttgaaagacctgctctggcgcgagctaaagcgcaattgtcaccaggtactgcaccaatggtggcgacagggtacagaagagcaagtactcctgactgggcaatgggactgcattgcatatccctaggcacctattgagacttatctggggcccaccagcgtggagttcctgtatgggaatgcaggactggacttgtgctgcctgacagggtcgcggctggccgtctgtactttgtatagtcagttgaaactcacc

SEQ ID NO: 462 - DNA, 421 bp, Human poliovirus 1
  strain NIE1116623, complete genome.1
agtctggacatccctcaccggcgacggtggtccaggctgcgctggcggcctacctgtggtccaaagccacgggacgctacatgtgaacaaggtgtgaagagcctattgagctacaaaagagtcctccggcccctgaatgcggctaatcccaaccacggatcaagggtgcacaaaccagtgtacaccttgtcgtaacgcgcaagtctgtggcggaaccgactactttgggtgtccgtgtttcctttttaattttgatggctgcttatggtgacaatcatagattgttatcataaagctaattggattggccatccggtgagagtgaaatatattgtttacctccctgttgggtttactctaactaacttctccatttataaacttgtcatcacagttttaataattagaagtgcagtttaca

SEQ ID NO: 463 - DNA, 423 bp, GB virus C
  isolate GBV-C_agmMal_seqID_10 putative polyprotein gene,1
catggacgaaagcccgtggatggacggtgacagggttggcaggtcgtaaatcccggccgccctggtagcgggtataagtctgagggaaacccactagaggcttacgtgttcttgtccgagtggacgtgcacggtccacaggagacgcctattccggtgtgaataataggccgactcgagcggagtcgttaaactgaggaccgtctgagagatggtaacttggcctgcgtacgggaacgccgctaaagaatacagtgggttaagtccggcgggttggcaatcccagcagggcgggggggttctactgttgaatcctgccagttcctctcagatggtaggcatggggggacccagctccgcggcgcgctacagccggggtagcccaaaatccttcgggtgagggcgggtcccatgtccctttttg

SEQ ID NO: 464 - DNA, 423 bp, Hepatitis G virus
  polyprotein gene, complete cds.1
gtgcaagccccacaaaccgacgcctatttaaatagacgttaagaaccggcgcctgcccggcgaccggccaaaagttggtggatgggtgatgccagggttggtaggtcgtaaatcccggtcatcttggtaaccactataggtgggtcttaagggttggtcaaggtccctctgaaccctgtggcgagaaagcgcacggtccacaggtgttggccctaccggtgtgaataagggcccgacgtcaggctcgtcgttaaaccgagcccattacccacctgggcaaacaacgcccacgtacggtccacgtcgcccttcaatgtctctcttgaccaataggctttgccggcgagttgacaaggaccagtgggggctgggcgtcgggggaaggacccccggcgctgcccttcccggtggggtgggaaatgc

SEQ ID NO: 465 - DNA, 424 bp, Hepatovirus D2
  isolate FO1AF48Rhilan2010 polyprotein gene, complete1
gtcttcttttatccgggctcacgtgatgccaatggtccgacccatgcgcccgtgggggttaacacatggattagccatgtgctgtaggccctaaaagtcacgttcacgtaaggcttggatgaaactcatgtctgttaactgagggtggtaagttacattgatcttctaaagagggtaggctacgggtgaaaccctctaggttagtactcatattgagagatacctccagtaggtgaaggtttccggatattggtgagtttaacgacaataaccattcaacggatgtgggcccacctcactggttagatgccttgtaatccaacacccaaggggatatgagtgaattcttagtcccaagtgaccctcccgaaaggttgtaggggtactcaggggcatttaggttttccacatttaaagtgaattg

SEQ ID NO: 466 - DNA, 426 bp, Porcine teschovirus
  complete genome.1
ccccccccctccccctttgaacttgtaactggtaagtgatgatccttggaagctaggtacctgttacgctagttttggattatcttgtgcccaacactagtctttggacttctgttgtgtttaaacacagaaatctgattgcttggttatgaattcactggactaacccttttgaaagacctgctctggcgcgagctaaagcgcaattgtcaccgggtattgcaccaatggtggcgacagggtacagaagagcaagtactcctgactgggcaatgggactgcattgcatatccctaggcacctattgagatttctctggggcccaccagcgtggagttcctgtatgggaatgcaggactggacttgcgctgcctgacagggtcgcgggtggccgtctgtactttgtatagtcagttgaaactcacc

SEQ ID NO: 467 - DNA, 426 bp, Porcine teschovirus 8
  isolate Fuyu/2009/2, complete genome.1
ttgaaaccccctccctttgaatttgtaattgataagtgatgatccttggaagctaggtacttgatacgctagttttggattgtcttgtgcccaacattagtctttggacttctgttgtgtttaaacacagaaattttgttatctggctacgaattcattggattaatccctctgaaagacctgctctggcgcgagcgaaagcgcaattgtcaccgggtattgcaccaatggtggcgacagagtacagaagagcaagtactcctgactgggcaatgggactgcattgcatatccctaggtacctattgagatttctctggggcccaccagcgtggagttcctgtatgggaatgcaggactggacttgtgctgcctgacagggtcgcggctggccgtctgtactttgtatagtcagttgaaactcact

SEQ ID NO: 468 - DNA, 426 bp, Porcine teschovirus 1
  JPN/Ishi-Im7/2016/G1 genomic RNA, nearly1
cccccctcctctccttttggactcgtaactgataagtggtagtccttggaagctaggtactcgttacgctagttttggattatcttgtgcccaacattggacctcggtcctgtgttgtgtttaaacacagaaatcttgacacttggttatgaattcattgtatcaacccttttgaaagacctgctctggcgcgagcaaaagcgcaattgtcaccaggtattgcaccaatggtggcgacagggtacagaagagcaagtactcctgactgggtaatgggactgcattgcatatccctaggcacctattgagatttctctggggcccaccagcatggagttcctgtatgggaatgcaggactggacttgtgctgcctgacagggtcgcggctggccgtctgtactttgtatagtcagttgaaaagcacc

SEQ ID NO: 469 - DNA, 427 bp, Simian pegivirus
  isolate myb_M23 polyprotein precursor, gene,1
ctggacgaaagcccgtggacgggcggtgacagggttggcaggtcgtaaatcccggccgccctggtagcgggtataagtctggaggaaacccgtgaaccggcagcgtgaagctctgctagcgaacgtgcacggtccacaggagacgccgattccggtgtgaataatcggccgactcgagcggagtcgttaaactgaggaccatcagggagatggcaacttggcttgcgtacgggaacgccgctaaagtcacagtgggttaagtccggcgggttgacaatcccagcaaggcgagggggtgctattgttgcaccctgccagtccctcccttttggtaggcatggggggacccagctccgcggcgcgctacagccggggtagcccaaaatccttcgggtgagggcgggtcccatgtcccttttattcaggc

SEQ ID NO: 470 - DNA, 427 bp, GB virus C
  isolate VSAC1003, complete genome.1
tggacgaaagcccgtggatggacggtgacagggttggcaggtcgtaaatcccggccgccctggtagcgggtataagtctgagggaaacccactagaggcttacgtgtacttgtccgcgtggacgtgcacggtccacaggagacgcctattccggtgtgaataataggccgactcgagcggagtcgttaaactgaggaccatttgtaagatggcaacctggcctgcgtacgggaacgccgctaaagaatacagtgggttaagtccggcgggttggcaatcccagcagggcggggggactctattgttgagccctgccagttccttacaagtggtaggcatggggggacccagctccgcggcgcgctacagccggggtagtccaaaatccttcgggtgaggacgggtcccatgtccctttttatggctc

SEQ ID NO: 471 - DNA, 427 bp, Theiler's disease-associated virus
  isolate B2 NS3 gene, partial1
cggcgcggtgttttgggttcagggcagtaggggcagccgggccagcagtagctggctcctggtaccaccaccctacccggacgacctccctcgcgaaaggtcgccacggtctgtggctcgacgacgcctacaattcagtccgaggggcgcagccctcgttaaactcagacttgattcctcgcctttgatctggccaggggtttaagtgaacgccgcccttttaatgtttaatagggttctttcccggcgggttgacaaacacttccctgggcttttcttcggcttcggtttcatgttgcttcggcacccatgagcgcacaggggggggaccctgcgacagtccgccaagaggaaaatccttcgggtgacctcgtgcgcaacccaatccctttctcttccacatggcgtgtctgtggtgcatgctgtg

SEQ ID NO: 472 - DNA, 428 bp, Sicinivirus sp.
  strain RS/BR/2015/1R-1 polyprotein gene, complete1
tggctggaagcattcagtttctggatttgttggtttgtggtgattagtagaccccctggaggtacccgttctggatctgaccagggacccgtgactataccgttccggtaattcgggtttaaaactatgaacgtcaccacccattttcttttcctattttattttttcttatattctgatatacgtgtgagtattgatgttccctgatctttgtgtctggtctgcattttcagttattcaatttggttgggctgggctctttatttagatgtttttagaggtctttcttgttattgtagcgctcgttgttgtggtattgtctcctagcgaattatcccagctgttgactatttgcatctacaactttgtcttgatttttctctggttatttggtaccttagagctccccaattatcccaccattcatc

SEQ ID NO: 473 - DNA, 430 bp, Sapelovirus A
  isolate PSV_GER_L00798-K11_14-02_2014 genome1
cccctccacccttaaggtggttgtatcccacataccccaccctcccttccaaagtggacggacaactggattttgactaacggcaagtctgaatggtatgatttggatacgtttaaacggcagtagcgtggcgagctatggaaaaatcgcaattgtcgatagccatgttagtgacgcgcttcggcgtgctcctttggtgattcggcgactggttacaggagagtaggcagtgagctatgggcaaacctctacagtattacttagagggaatgtgcaattgagacttgacgagcgtctctttgagatgtggcgcatgctcttggcattaccatagtgagcttccaggttgggaaacctggactgggcctatactacctgatagggtcgcggctggccgcctgtaactagtatagtcagttgaaaccccccc

SEQ ID NO: 474 - DNA, 430 bp, Sapelovirus A
  isolate PoSapV_VIRES_NM02_C1 polyprotein gene,1
cctccacccttaaggtggttgtatccccataccctaccctcccttccaaagcggatggatatacggacctgaacttttggcgagtacatatggtatgattattggatacaccctgaatggcagtagcgtggcgagctatggaaaaatcgcaattgtcgatagccatgttagtgacgcgcttcggtgtgctcctttggtgattcggcgactggttacaggagagtaggcagtgagctatgggcaaacctctacagtattacttagagggaatgtgcaattgagacttgacgagcgtctcctagagatgtggcgcatgctcttggcattaccatagtgagcttccaggttgggaaacctggactgggcctatactacctgatagggtcgcggctggccgcctgtaactagtatagtcagttgaaaccccccc

SEQ ID NO: 475 - DNA, 430 bp, Human rhinovirus B
  strain HRV-B35_p1135_sR738_2007 polyprotein1
cgcgaggcataggttgtacccacggccaaaaaccttcaaccgttacccgccaatcaactacgtaacagctagtatcatcatgtctttgtctaggcgttcgatcaggtggttttcccctccactagtttggtcgatgaggctaggaaatccccacgggtgaccgtgtcctagcctgcgtggcggccaacccagcatcagctgggacgccttttcagagacatggtgtgaagactcgcatgtgcttgattgtgattcctccggcccctgaatgcggctaacctcaaccccggagccttgtattgcaatccagcaatattaaggtcgtaatgagcaattctgggacgggaccgactactttgggtgtccgtgtttcctgtttttcataaatttttcttatggtcacagcatatagtacatatatactgtgatc

SEQ ID NO: 476 - DNA, 431 bp, Human enterovirus
  isolate EV/Human/CMRHP58/CMR/2014 polyprotein1
aggtcgatgagtcactgcattccccacaggcgactgtggcagtggctgcgttggcggcctgcctatggggcaacccataggacgctttaatgttgacacggtgcgaagagtctactgagctagttagtagtcctccggcccctgaatgcggctaatcctaactgcggagcgcacaccagcaaaccagctggtaatgcgtcgtaacgggcaactctgcagcggaaccgactactttgggtgtccgtgtttccttttattcttattatggctgcttatggtgacaatctaagattgttatcatatagctattggattggccatccggtgactaacagacacatcatttacctttttgttggatttgttccactaaactcactctcatatcaaaccttattgtacatccttaagtccaattatttaaagcaact

SEQ ID NO: 477 - DNA, 432 bp, Hepatitis G virus
  polyprotein precursor, gene, complete cds.1
gggtgatgacagggttggtaggtcgtaaatcccggtcatcttggtagccactataggtgggtcttaagggctggtcaaggtccctctggcgcttgtggcgagaaagcgcacggtccacaggtgttggccctaccggtgtgaataagggcccgacgtcaggctcgtcgttaaaccgagcccgttacccacctgggcaaacaacgcccatgtacggtccacgtcgcccttcaatgtctctcttgaccaataggctttgccggcgagttgacaaggaccagtgggggttgggcggtgggggaaggacccctttcgctgcccttcccggtggggcgggaaatgcatggggccacccagctccgcggcggcctgcagccggggtagcccaagaaccttcgggtgagggcgggtggcatttccttttctgtaccgatc

SEQ ID NO: 478 - DNA, 433 bp, Human parechovirus 17
  strain M36/CI/2014 polyprotein gene, complete1
ctctattagtgagataccacgcttgtggaccttatgctcacacagccatcctctagtaagtttgtaagacgtctggtgacgtgtgggaacttgtgggaatcaatattttgctttaaagcatccattagccagcggataaaacacctggtaacaggtgcctctggggccaaaagccaaggtttaacagaccctagtggattggtttcaaaacctgaaatattgtggaacacactcagtacctactgatctggtagtaatgcaagcactagttgtaaggcccacgaaggatgcccagaaggtacctgtagggaacaagagacactatagatctgatctggggctggctacctctattttggtgagtcagttaaaaaacgtctagtgggccaaacccaggggggaccctggtttccatttattttacaaaggcact

SEQ ID NO: 479 - DNA, 433 bp, Picornaviridae sp.
  isolate yc-4 polyprotein gene, partial cds.1
agtagtggccgtaagccacttttctttctttataacctatcactatactccaacttaatcttctctacttggactaggatctactggttatcgatgagtcgtgatgcttagtgatttggatagggaaatcccacctgagggtaccgatggtatcactcaaacgggtaggggagatacccatttgctattggctgaaccggattaccgatgtacgccagtattagcagtggggcaaatacctccccgagcattatggttagagacagaactacgggtgctagccccggtggcattgcctagtagggttccgacctaatggtattggaaaccacccgtagtaaggtgagtgttggggaacctcaccagtgtctgttactgcctgatagggtcgcggctggccgaatcataatgcttaatgtcagttgaactagtc

SEQ ID NO: 480 - DNA, 438 bp, Human rhinovirus C50
  strain human/Australia/SG1/2008, partial1
ttccccggacgtgtgaataggctccaccaggggctgaagctgtagcgttcgttacccgcactgctactacgcaagggttagtatctaactgaaaacattgtggagtttcgctcagcagaaccccactgtagatcggggtaatggggctacacaacccccaccggcgacggtggtgtagcccgcgtggtgccccgcctgaggcttgtgcctcaggacgccacaatgttgacagggtgagaaggcctacgtgtgctagcagtgagtcctccggcctctgaatgcggctaatcctaaccccatagccatcacacacaatccagtgtgcaggtggtcgtaacgggtaactatgggatggaaccgactactttgagtgtccgtgtttcctattttacctttacatgtcttatggtcacaatatagtgtatacatattgtgatc

SEQ ID NO: 481 - DNA, 439 bp, Human rhinovirus B
  strain HRV-B69_p1162_sR1549_2009_g1 polyprotein1
gttaccccggagcggagtatagatggccaccgctgtcaaaagctcttaaccgttacccgccagttaactacgcaacggctagtagcatcctgttgccttcatggcgttcgatcaggtgagacttccctcctcactagtctggtcgatgaggctgagaactccccacgggcgaccgtgtctcagcctgcgtggcggccagcccagcttttgctgggacgccttgattgagacatggtgtgaagacccgcgtgtgcttaactgtgagtcctccggcccctgaatgcggctaacctaaaccctggagccttgaaacacaatccagtgttcgcaaggtcgtaatgagcaattccgggacgggaccgactactttgggtgtccgtgtttcctttttacctttcaattgttcttatggtcacaatataagtgttatattgtgatc

SEQ ID NO: 482 - DNA, 439 bp, Human rhinovirus C
  strain HRV-C40_p1009_s3787_1999 polyprotein1
tccccggcatgagaggaatagactctttcagggttgaagccacgagtgtcgttacccgcactggtactacgcaaagcctagtaacatcttgaaactctttttggttggtcgttccactagttaccccctagtagacctggcagatgaggcaggacgctccccactggcgacagtggtcctgcctgcgtggctgcctgcacacccttcggggtgtgaagccaaaagaaagacaaggtgtgaagagccccgtgtgctaccagtgaatcctccggcccctgaatgcggctaatcttaccccacagctattgcacacaatccagtgtgtatgtagtcgtaatgagcaattgtgggacggaaccgactactttgggtgtccgtgtttccttttattcccatgtttctgcttatggtgacaatactgacgtatagtgttgttacc

SEQ ID NO: 483 - DNA, 439 bp, Coxsackievirus
  A20,isolate ETH_P10/A20_2016 polyprotein gene,1
tgtagatcaggctgatgagtcactgcactcctcacgggcgaccgtggcagtggctgcgttggcggcctgcctatggggcaacccataggacgctctaaagtggacatggtgcgaagagtctattgagctagttagtagtcctccggcccctgaatgcggctaatcccaaccacggagcaagtgctatcaaaccagagagtggcttgtcgtaatgcgcaagtctgtggcggaaccgactactttgggtgaccgtgtttccttttatttttatcgtggctgcttatggtgacaatctcagattgttatcataaagcaaattggattagccatccggtgaaagtcaaatcgattatttacttacttgttagtttttctccactaacaccacaaacacttaaaattattgaaatagtgctgctaattagataccactatcata

SEQ ID NO: 484 - DNA, 442 bp, Pasivirus A3
  isolate CS15-4016, complete genome.1R
aagcgactcttccgacgacgaggagcagtgggacgccttcgagtcaactgaccgcccgaagaaggagaaacggcgggaacagaagactcgagagatcacccagccccgatctccaaggaaaaagtcaccgccgcgacactaaacgacctccacccctgcattgagtctgccaataaaccctcgaatactttctgtcgtcctcttttttcctttaacctttcgtgggagagcagcgccgcgcggtcctcctcctctttccgacaccgttccatcgcattcaggaacgggtccaacccctcaccgcaattacgcacttccgcaaggccacgcaaaaagtgaccattgcaccgtgccaaacccctccctcagttaatattaacagccgtcctcaatatccttctaccttccgtgacaggacacagtctccgaacaacccagagca

SEQ ID NO: 485 - DNA, 443 bp, Porcine enterovirus 8
  strain V13, complete genome.1
acactcatttcccccctccacccttaaggtggttgtatcccctacaccctaccctcccttccacataggacgaataaacggacttgagattaaggcaagtacataaggtatggtttttggatacacttaaatggcagtagcgtggcgagctatggaaaaatcgcaattgtcgatagccatgttagcgacgcgcttcggcgtgctcctttggtgattcggcgactggttacaggagagtagacagtgagctatgggcaaacccctacagtattacttaggggaatgtgcaattgagacttgacgagcgtctctttgagatgtggcgcatgctcttggcattaccatagtgagcttccaggttgggaaacctggactgggtctatactgcctgatagggtcgcggctggccgcctgtaactagtatagtcagttgaaaacccccc

SEQ ID NO: 486 - DNA, 443 bp, Porcine sapelovirus 1
  isolate IVRI/PSV/SPF/C-6/2015, complete1
acacccatttcccccctccacccttaaggtggttgtatcccctataccctatcctcccttccaaacaggatggacaaatggacttgacattatggcaagtacataaggtatggtctttggatacacctgaatggtagtagcgtggcgagctatggaaaaatcgcaattgtcgatagccatgtcagtgacgcgcttcggtgtgctcctttggtgattcggcgactggttacaggagagtaggcagtgagctatgggcaaacccctgcagtattactcaggggaatgtgcaattgaggcttgacgagcgtctcttagagatgtggcgcatgctcttggcattaccatagtgagcttccaggttgggagacctggactgggcctatactacctgatagggtcgcggctggccgcctgtaactagtatagtcagttgaaaacccccc

SEQ ID NO: 487 - DNA, 443 bp, Enterovirus E4
  complete genome.1
ctacgtctgataagattgatctgaaatctgagaatagagatttatttagaattgtttcatattcgggaaccgtgcagtggagagcattgtgcggtccttgcagacggggggtggggacattgcctcaaatacctttgcttgaaaggcctttgccaacacagcctttgtgcaactgcagcttttgcagcccattgcttgcagaagcagcacctttagttactgtagattctggaggtggttccagatcagcgattcctactgggccttgcgactgcgaggagtgcagtggtaataggacacccgacggggaggaggaaccaggagcaagaaatacaagtagccctgacagttctgtttgtggttgtcctctttgcgagggagaaattattaacgtttaagcttcttgctcatatttggggcgtaggtataataaagcaaaaatt

SEQ ID NO: 488 - DNA, 445 bp, Unknown
  Description of Unknown: Hepatitis GB virus B subgenomic replicon neoRepB.1 sequence
accacaaacactccagtttgttacactccgctaggaatgctcctggagcaccccccctagcagggcgtgggggatttcccctgcccgtctgcagaagggtggagccaaccaccttagtatgtaggcggcgggactcatgacgctcgcgtgatgacaagcgccaagcttgacttggatggccctgatgggcgttcatgggttcggtggtggtggcgctttaggcagcctccacgcccaccacctcccagatagagcggcggcactgtagggaagaccggggaccggtcactaccaaggacgcagacctctttttgagtatcacgcctccggaagtagttgggcaagcccacctatatgtgttgggatggttggggttagccatccataccgtactgcctgatagggtccttgcgaggggatctgggagtctcgtagaccgtagcac

SEQ ID NO: 489 - DNA, 445 bp, Unknown
  Description of Unknown: Human coxsackievirus B3 polyprotein gene, complete cds.1 sequence
gcacaacccaagtgtagatcaggctgatgagtcaccgcattccccacgggtaaccgtggcggtggctgcgttggcggcctgcccatgaggcaactcatgggacgcttcaatactgacatggtgcgaagagtctattgagctaattggtagtcctccggcccctgaatgcggctaatcctaactgcggagcagatacccacatgccagtgggcagtctgtcgtaacgggcaactctgcagcggaaccgactactttgggtgtccgtgtttccttttatttctattttggctgcttatggtgacaattgagagattgttaccatatagctattggattggccatccggtgacaagtagagcaattatctacctatttgttggctttgttccactgaattttagagttctaaaaaccttaacttcattttagcactcaatacggcaaa

SEQ ID NO: 490 - DNA, 446 bp, Rhinovirus C
  isolate HRV-C55_ID529T_5UTR/2A polyprotein gene,1
gcacttctgtttccccggacgtgtgaataggcctcaccaaggctgaagctgtagcgttcgttatccgctcacctactgcgcaaagactagtaactaactagatacttagtggtgtttcgctcagcagtaccccactgtagatcggggcaatgaggctacgcatcccccactggcgacagtggcgtagcctgcgtggtgccctgcccaggcttcggtctgggacaccactatgttgacagggtgtgaagaccggcgtgcgctaggtgtgactcctccggcccctgaatgcggctaatcctaaccccgcagccaccgcatgcaacccagcatgtagatggtcgtaacgagtaattgtgggatggaaccgactactttgggtgtccgtgtttcctgtttttctttattgttgtcctatggttacaaatttgtgtatcagatttgtgacc

SEQ ID NO: 491 - DNA, 449 bp, Human rhinovirus C35 clone LRTI-metagenomic-1 polyprotein gene,1
agctctgcagatatctccccggacgtgtgaataggccctaccagggctgaagctgtagcgttcgttatccgcatgcctactgcgcaaaggttagtaactaactagatacttagtggtgtttcgctcagcagtaccccactgtagatcagggtaatgaggctacgcatcccccactggcgacagtggcgtagcctgcgtggtgccctgcccaggtttatacctgggacaccactatttggacagggtgtgaaggccagcgtgcgctaggcatgagtcctccggcccctgaatgcggctaatcctaaccctgcagccattgcatgcaaaccagcatgttggtggtcgtaatgagcaattgcgggatggaaccgactactttgggtgtccgtgtttcttgtttttccattaattgtcttatggttacaagtttgtgcaacaaatttgtgacc

SEQ ID NO: 492 - DNA, 450 bp, Simian pegivirus
  isolate VGA00020, complete genome.1
tagagtggttgcgctggaatctggacgaaagccagcggatgggtggtgacagggttggcaggtcgtaaatcccggccatcctggtacctggtataagtctgaaggaacgcgcaagcaactagtgcgatttgttggcaaagtttgagtgcacggtccacaggtgacgcctataccggtgtgaataataggccgactcgagcggagtcgttaaactgaggacccccttggcgatcgcaacttggcctgcgtacgggaacgccgctaaagtcacagtgggttaataccggcgggttgacaatcccagcagggcgggggggagctactgttgcatcctgcgagttccgtcttgggggtaggcatggggtggcccagctccgcggcgcgctacagccggggtaggccaaaaatccgaaaggtgaggccgggccacatgtccgtttttatttaccc

SEQ ID NO: 493 - DNA, 452 bp, Bat pegivirus
  isolate PDB-24 polyprotein gene, complete cds.1
taaatcccggtccaggtttattcagtatatgataggtggagtcgagccccccgaccggggctctgtgaccactgtccagccggacgaggtggtgaaagttgttcgggcacggtccacaggttgggttcaccggtgtgaatagagccccgtctcgagcggagacgttaaacttagatggtctgcaggatggcaacgcggcccgcgtacgggaacgtcgcaaaataccttcgggaacagtgcatgcagcgggttgtcaaacccagcggtggcgcgctccggagaggtggagccctcaatggaggccagttccctgcagaaccagcccttcggggcaggcatggccccccccagccggcgcggcgctacacgcggcaagaggaagagccttcgggtgacctcgggggggatttgtccctttcaacccaatgagagttcgtgcgttggtcgcagtc

SEQ ID NO: 494 - DNA, 455 bp, Porcine sapelovirus 1 PSV/Porcine/JPN/Ishi-Miya3/2015 gene for1
cgcatgtattccacactcatttcccccctccacccttaaggtggttgtatccacttaccctatcccccccctccaaagcggacggactcttggacctgaaactctggcaagttaaatgataagatatctggatacacttgaatggcagtagcgtggcgagctatggaaaaatcgcaattgtcgatagccatgttagtgacgcgcttcggcgtgctcctttggtgattcggcgactggttacaggagagtagacagtgagctatgggcaaactcctacagtattacttaggaggaatgtgcaattgagacttgacgagcgtctcttagagatgtggcgcatgctcttggcattaccatagtgagcttccaggttgggaaacctggactgggtctatactacctgatagggtcgcggctggccgcctgtaactagtatagtcagttgaaaccccccc

SEQ ID NO: 495 - DNA, 455 bp, Coxsackievirus
  A20,strain NGR_2016, complete genome.1
gcagtagagatgggagtgtagcttaggtcgatgagtctggacattcctcaccggcgacggtggtccaggctgcgttggcggcctacctgtggcccaaagccacaggacgctagttgtgaacaaggtgtgaagagcctattgagctacaaaagagtcctccggcccctgaatgcggctaatcccaaccacggagcaagtgctcacaaaccagtgagtggcttgtcgtaacgggtaactctgtggcggaaccgactactttgggtgtccgtgtttccatttatttttacaatggctgcttatggtgacaatcgttgattgttatcataaagcgatttggattggccatccggtgaaagtgaaatatattatttatctttttgttggattcgctccaatcaactcctttacttacaaactcatcacaacagtactactaattaggaacatataccact

SEQ ID NO: 496 - DNA, 455 bp, Rhinovirus C
  isolate HRV-C16_ID639T_5UTR/VP1 polyprotein gene,1
tgcacttctgtttccccggtactagggtgttaaacttccccagaggttgaagcccgatgtatcgttacccgcatggttactaagcagagcctagtagcatcttgctttgcatatgagctggtcgttcagtcagtaaaccccctgatagacctggcagatgaggctggaaataccccactggtaacagtgttccagcctgcgtggctgcctgcccctcttttgaggggaagcccatatgtagacaaggtgtgaagagccgcgtttgctaactatgagtcctccggcccctgaatgcggctaatccaaccccacagctactgcgcagaaaccactgcgtaggtagtcgtaatgagcaattgtgggacggaaccgactactttgggtgtccgtgtttcctgttttactttacattgctcatggacacaacatatataaaatcgtatatgttgttcacc

SEQ ID NO: 497 - DNA, 457 bp, Chicken picornavirus 3
  isolate 45C, complete genome.1
gggtatggtggttaaccccgtccactgggcatctttgccctctcagaagtggatcaatccaccccaactccccccctggttacctgagccacagtggactccggtgacgaagctagggaccccaatacctcaagtgccaagagagtccccccctcgcgagaggtgctcttgggcccaaaaggctagttggcagagtgaagtgaaggaagctgctaacgtggtgaccttaagcgtaattcgaagctgacctttgaggttaaccctagtggaccactggaggaatctgtggaggtggtggttaggaaagttggccacttgtgagtagatgcccagaaggcataaggctgatctggggccagtgactataccgttccggtaaacctggtataaaaaccatgaaagcaagtgggtgaaattttctctttttatccttcattcagcagttgatattggcaaa

SEQ ID NO: 498 - DNA, 460 bp, Picornaviridae sp.
  isolate ybb044pic01nc genomic sequence.1
aaaagactcgctaactcaaaactctctcactctcactctccactcccaaactattatccgactaagtgacccactaactaatccaaaattccaatcctacactatcttgcacctttcactctcctctatctaatctataaagctcttacaactaaacctctccataccccattacaaccgcaaaatctacgaattcaaataaactcccaattgcccgaaaattcacttccacctaattctctcaaaatttctgactcactctcagaacaaaccaattcagtgcaaactgaacatacactctcccctgaacaaacgcagcaactcctccaaaccactcttaagactgcgtctcaaatttttgctcaactccaagagaaacaaatctcttctccccagaaagttaatactccaacgctctctgattcctcctccgaccccactcttcaacaagcttcatatc

SEQ ID NO: 499 - DNA, 460 bp, Red-necked stint Picornavirus B-like
  polyprotein gene, complete1
ctccactctcctttctcccttccccctccctttaccttttccccctctgtaactaagttttgtccctgcagagcagtgatacgacataaccgagttggaacgcgtattgggtattggtgaatatctatctcatgtggttaagctaaggcttgaaatacctttggcattgggttatagtagggcattagtgttcccacatgagagaaccatctatccacttgacacagtgggtgtatagtacaaaggaccctatttggtatcctgacgcgtgggcgagtaagtcttgctggatttccgcgagcatcaaccacaccctgatagtctcaatggggtcactcccgagacggggcaagtcacctatacactacctatggttgggaagccatagctggactgtgacagcttgatagagtgtcggcgggcacagtggattggatgtaaagtccgttgaaatgccatt

SEQ ID NO: 500 - DNA, 464 bp, Sapelovirus A
  strain SZ1M-F/PSV/HUN/2013, complete genome.1
ttcggcacgcatgtattccacactcatttcccccctccgcccttaaggtggttgtatcccataacctttaccctcccccttcccagtcggacggaactatagttcatagacttagattctgtattaaggtgtgactaggatcaaccccatgtggcagtagcgtggcgagctatggaaaaatcgcaattgtcgatagccatgttagtgacgcgcttcggcgtgctcctttggtgattcggcgactggttacaggagagtaggcagtgagctatgggcaaacctctacagtgttacttagagggaatgtgcaattgaggcttgacgagcgtctccttgagatgtggcgcatgctcttggcattaccatagtgagcttccaggttgggaaacctggactgggcctatactacctgatagggtcgcggctggccgcctgtaactagtatagtcagttgaaaccccccc

SEQ ID NO: 501 - DNA, 465 bp, Rhinovirus C
  strain SCH-108 polyprotein gene, complete cds.1
cagcggtcaagcacttctgtctccccggcatagggatgttaggcttctcacgaggctgaagtcccgattgtcgttatccgcacaactactggacaaagcctagtaacaccctacgacgtagtatggttggtcgttccaccagtgaatccccccctggtagacctggcagatggggctagaaattcctcactggcgacagtgttctagcccgcgtggctgcctgctccctaacgggagaagccatcctactgacaaggtgtgaagagccccgtacgctagttgtgagtcctccggcccctgaatgcggctaatccaaccctgcagccattgcatggaagccaccatgtagatggtcgtaatgagtaattgcgggacggaaccgactactttgggtgtccgtgtttcttttatttcttgtatattgcttatggtgacaatatatatacagcatatatattgttcatc

SEQ ID NO: 502 - DNA, 466 bp, Genet fecal theilovirus
  isolate S15 polyprotein gene, partial cds;1
atggggaagggtatgacgtgccccttccttcttcggagaactcgctctagtggtctttccacttctggaaaagagtgagtgcacgtgatcaggaccgtcgaagacgacaaatacctggtgctctatctcatagacgtttcacagctgtagcgacccctcagtagcagcggaagccccctcctggtgacaggagcctctgcggccaaaagccacgtggataagatccactgctgagggcggtgcgaccctagcaccctgtgatgcatactagttgtagcgtgccggactattggtctgtcataagacacctgatagagagaccaagaatgtcctggaggtaccccgcgtgcgggatctgaccaggagaccattgcccaatgctttacaacgggtctatggtttaaaaactgtcgcagtctctccaaaccaagtggtcttggttttcaattactttgaatatttcact

SEQ ID NO: 503 - DNA, 468 bp, Picornaviridae sp.
  isolate ybb117hav01 genomic sequence.1
aaaaggagggatacaaatggtaccacggacaagcgtggaaaaccacctgtatccccccttttgggcttggcaacccattaatcaagatgccttctcttttgccggttttaagactccattttgcctgctgaatctgatgtgttctcactagacgtgtagcttagcacgatggccaggtcttgtttatactggcataagccgggagaacggtcttacagtgatcttggagtttggttagtatctgctagagtggcgtaactgcagacatgttgcccagggccgtaggctaggtaactagcaccctgggggccgcaagcctaggtggtcacaaccaccctcatgtaacccttgtcgggcattcttgtagtagaacccctaactccacttttgctgggaccaagtaccctgtgagagcaatgtaagtagatgccctgtaggtacccgtttaggatctgagcaggggccggg

SEQ ID NO: 504 - DNA, 475 bp, Sapelovirus A
  strain DIAPD5469-10, complete genome.1
gtacatgcgtattacggtacgcatgtattccacactcatttcccccctccacccttaaggtggttgtatccactcaccctaccctcccttccaaagcggatggactttatgtgtttgaaactttggcaaccataaaaggaatggtatttggatacggatgaatggcagtagcgtggcgagctatggaaaaatcgcaattgtcgatagccatgttagtgacgcgcttcggcgtgctcctttggtgattcggcgactggttacaggagagtaggcagtgagctatgggcaaacctctacagtattacttagagggaatgtgcaattgagacttgacgagcgtctctttgagatgtggcgcatgctcttggcattaccatagtgagcttccaggttgggaaacctggactgggcctatactacctgatagggtcgcggctggccgcctgtaactagtatagtcagttgaaaccccccc

SEQ ID NO: 505 - DNA, 476 bp, Enterovirus J
  strain NGR_NHP_1, partial genome.1
aacacatcgctcaacagcagttccacatccagtgggattatgagcaagcactcctgtttccccggaagggactaacggtacgctgtacccacggcggaagtatgtcctaccgttaaccggccatgtacttcgagaagcctagtaccattatgaaggttgattgatgttacgctccccggtatccccaaccggtagttctggtcgatgagtctcggcatcccccacgggcgaccgtggccgaggctgcgttggcggccagcctacacccaccagggtgtaggacgtcatgatactgacatggtgtgaagagcctattgagctacgtggtagtcctccggcccctgaatgcggctaatcctaactccggagcatccgctaacaatcccgttagaagggtgtcgtaacgcgaaagtctggagcggaaccgactactttgggtgtccgtgtttcctgttttacttactgtttggctgctt

SEQ ID NO: 506 - DNA, 478 bp, Shanbavirus A
  isolate BtMf-PicoV-1/SAX2011 polyprotein gene,1
tgaaaagggggcgcagggtggtggtggttactaaatacccaccatcgccctgcacttcccttttcccctgtggctcagggtcacttagccccctctttgggttaccagtagttttctacccctgggcacagggttaactatgcaagacggaacaacaatctcttagtccccctcgccgatagtgggctcgacccccatgtgtaggagtggataagggacggagtgagccgatacggggaagagtgtgcggtcacaccttaattccatgagcgctgcgaagaaggaagctgtgaacaatggcgacctgaaccgtacacatggagctccacaggcatggtactcgttagactacgcagcctggttgggagtgggtataccctgggtgagccgccagtgaatgggagttcactggttaacacacactgcctgatagggtcagggcctcctgtccccgccgtaatgaggtagaccatatgcc

SEQ ID NO: 507 - DNA, 478 bp, Human rhinovirus B
  strain HRV-B06_p1198_sR1308_2009 polyprotein1
gtgcgccacatccagtggtgttttgtacaagcacttctgtttccccggagcgaggtataggctgtacccactgccaaaagcctttaaccgttatccgccaaccaactacgtaaaagctagtaacatcttgtttgtaatctggcgttcgatcaggtggatttcccctccactagtttggtcgatgaggctaggaatccctcacgggcgaccgtgtcctagcctgcgtggcggccaacccagcatatgctgggacgcccttttatagacatggtgtgaagactcgcatgtgcttggttgtgattcctccggcccctgaatgcggctaaccttaaccctggagccttgtattacaaaccagtgatattaaggtcgtaacgagcaattccgggacgggaccgactactttgggtgtccgtgtttctctttttactcattattgtcttatggtcacagcatatttgttaaatatactgtgatc

SEQ ID NO: 508 - DNA, 478 bp, Human rhinovirus
  NAT001 polyprotein gene, complete cds.1
gtgacaatcagccagattgttaacggtcaagcacttctgtttccccggtacccttgtatacgcttcacccgaggcgaaaagtgaggttatcgttatccgcaaagtgcctacgagaagcctagtagcacttttgaagcctatggctggtcgctcaactgtttacccagcagtagacctggcagatgaggctagatgttccccaccagcgatggtgatctagcctgcgtggctgcctgcacactctattgagtgtgaagccagaaagtggacaaggtgtgaagagcctattgtgctcactttgagtcctccggcccctgaatgtggctaatcctaaccccgtagctgttgcatgtaatccaacatgtctgcagtcgtaatgggcaactatgggatggaaccaactactttgggtgtccgtgtttcttgtttttctttatgcttgcttatggtgacaactgtagttattacatttgttacc

SEQ ID NO: 509 - DNA, 480 bp, Rhinovirus C
  isolate RV-C45-cpz1-2013 polyprotein gene, complete1
gtggtaaatccataccactaatggtcaaacacttctgttcccccggcatgtgaggaataggctccaaaagggctaaagccactagtgtcgttatccgcattggtactacgcaaagcctagtatcactctggaagtctctcggttggtcgctccaccaggtaccccactggtagacctggcagatgaggcaggactcaccccactggcgacagtggtcctgcctgcgtggctgcctgcacacccctacggggtgtgaagcctagagatagacagggtgtgaagagccccgtgtgctaccaatgagtcctccggcccctgaatgcggctaatcttaccccacagctgttgcacgcaatccagcgtgtatgcagtcgtaatgagcaattgtgggatggaaccgactactttgggtgtccgtgtttccttttattcctattatttgcttatggtgacaatattgatagcatcagtgttgtcatc

SEQ ID NO: 510 - DNA, 480 bp, Rhinovirus C
  isolate E0-9 polyprotein gene, partial cds.1
gtgcttgaccgtcagtaacctggatggtcaccacctattggtcattgtgtacaagcttctatatgtttcaccagaggcgaaaaacgaggttatcgttatccgcaaagtgcctacgagaagcctagtagcactttcgaaacctatggctggtcgctcagctgcttgcccagcagtagacctggtagatgaggctagacattccccaccagcgatggtggtctagcctgcgtggctgcctgcacacccaatcgggtgtgaagccagaaagtggacaaggtgtgaagagcctattgtgctcactttgagtcctccggcccctgaatgtggctaatcctaaccccgtagctgttgcatgcaacccagcatgtatgcagtcgtaatgggcaactatgggatggaaccaactactttgggtgtccgtgtttcttgttttacttttcattgcttatggtaacaattgtagttgatacacttgttacc

SEQ ID NO: 511 - DNA, 487 bp, Hainan gekko similignum picornavirus
  strain LPXYC222841 polyprotein1
gtgtccgggaagcgactcaagcttttgactgagtctctacaccttcatccgtaacatctttaagtttatgtgcctatggacctctagtgcactgccatcaccgggggtgtattggactggtttttccacaatccattcatcctgaggaattttggctttgttactaggatggtcccaccacacgcttatctgtgcctattgtgtcaaccatgttcttaagtagttgtgcccgtgggtgagtagataaccacaacaatccgataaagcatctcgcaaggatgtgagtaatggagtgtatgtgctacagagacccacaacctgaaccaagagagacacagtgaggattgtaaagggggaactctttgaaagggcatgtcccgcaattcctactgactgacaccgggggttggtgtcggtggattttagcaaatcctgttactgggtgatagccttgtgcacttcacttggttcttgtataagtgctgta

SEQ ID NO: 512 - DNA, 488 bp, Avian encephalomyelitis virus
  strain Pf-CHK1/AEV, complete genome.1
tttgaaagaggcctccggagactccggaggtattctttcgacccaacccatactggggggagtgtgggaccgtacttggagcgcacggtatatatgtgttcccgcatggcaagggcgtgttaccttgctccctgacgcatggtatgtgtcgatttgattttcaacttatcctaaggtctaggcgtttcgtgccgaaaacctctttgcgtttcacagaaccatcctaaccatgggtgcagtatgggaatcgtgtatgggggtgattaggatctctcatagagggataggtatgtcatcaaaccggggagtactccggctctggcattgggacatttgaattaaccggacctggttcagtatccgggttgtcctgtattgttacggtgtatccgtcttggcatactgaaagggtattcttgggtaatcctttcctactgcctgatagggtggcgtgcccggccatgagagattaagggtagcatttaacc

SEQ ID NO: 513 - DNA, 489 bp, Sapelovirus A
  strain JXXY-a2, complete genome.1
ttgaaatgggtgtggggtacatgcgtattacggtacgcatatattccacactcatttccccccctccacccttaaggtggttgtatccccataccttaccctcccttctaaaacagatggacaaatggatttgaacttatggcaagtgaatatggtatgactttggatacactttaacggcagtagcgtggcgagctatggaaaaatcgcaattgtcgatagccatgttagtgacgcgcttcggcgtgctcctttggtgattcggcgactggttacaggagagtaggcagtgagctatgggcaaacctctacagtattacttagagggaatgtgcaattgagacttgacgagcgtctcttagagatgtggcgcatgctcttggcattaccatagtgagcttccaggttgggaaacctggactgggcctatactacctgatagggtcgcggctggccgcctgtaactagtatagtcagttgaaacccccc

SEQ ID NO: 514 - DNA, 489 bp, Cardiovirus B
  strain Ruian-Rn93-3 polyprotein gene, complete cds.1
gttcgtctgctttctgagtactattcatgaaaagggtatgtgctaccccttccttcttggagaatctgcgtggcggtctttccgtctcttgaaaagcgcagatgtagcatgctggaaccggtgaagaaaacagttctctgtggagacttagagcagacatcgaaacagctgtagcgacctcacagtagcagcggaaccccctcctggtgacaggagcctctgcggccaaaagccacgtggataagatccactgctgtgagtggtgcaaccccagcaccctggttcgatggttgttctctgtggaatcagggaatggttattctcaagccctccagtagagaagccaagaatgtcctgaaggtaccccgcgtgcgggatctgatcaggagatcagttaccagtgctctacactggtactctgatttaaaaaatgtcacagcttctccaaaccaagtggtcttggttttccttttacctacaaagttcatg

SEQ ID NO: 515 - DNA, 489 bp, Human rhinovirus A
  strain HRV-A28_p1292_s6470_2000 polyprotein1
gaagaccaataggcggtggttatccaaaccatcaacggtcaagcacttctgtttccccggttagattgatacgctccaacagggcgaaaacaactctaatcgttatccgcaagatgcctacgcaaagcttagtatcacctttgattctatttggttggtcgctcagctacaaacccagtagtagacctggcagatgaggctagaaacaccccactggtaacagtgttctagcctgcgtggctgcctgcacaccctatgggtgtgaagccgactagttgacaaggtgtgaagagccccgtgtgctcatcttgattcctccggcccctgaatgtggctaaccttaaacctgcagccaatgtacacgatccagtgtgctgttggtcgtaatgagtaattgcgggatgggaccaactactttgggtgtccgtgtttctctttttacctttattattgcttatggtgacagtatatggtatatatattgtcact

SEQ ID NO: 516 - DNA, 491 bp, Porcine sapelovirus
  isolate KS05151, complete genome.1
ttgaaatgggtgtggggtacatgcgtattacggtacgcatgtattccacactcatttcccccctccacccttaaggtggttgtatccacataccctaccctcccttccacacaggacggacttttggacttggaccttcggcaagcacatatggtatgattactggatacaccttgaatggcagtagcgtggcgagctatggaaaaatcgcaattgtcgatagccatgttagtgacgcgcttcggcgtgctcctttggtgattcggcgactggttacaggagagtaggcagtgagctatgggcaaacctctgcagtattactcagagggaatgtgcaattgagacttgacgagcgtctctttgagatgtggcgcatgctcttggcattaccatagtgagcttccaggttgggaaacctggactgggcctatactacctgatagggtcgcggctggccgcctgtaactagtatagtcagttgaaaccccccc

SEQ ID NO: 517 - DNA, 491 bp, Rhinovirus A
  isolate HRV_A_SK001, complete genome.1
aaagtgaccaataggcggcaatcacccagattgtcaaaggtcaagcacttctgtttccccggtcgaagctgatatgctccaacagggcaaaaacagctgagatcgttatccgcaaagtgcctacgcaaagcctagtaacattttcgaagttatatggttggtcgctcagccaaaccccatggtagacctggcagatgaggctagaaataccccactggtgacagtgttctagcctgcgtggctgcctgcacaccctctgggtgtgaagccatataatagacaaggtgtgaagagccccgtgtgctcactttgagtcctccggcccctgaatgtggctaaccttaaccctgcagctagtgcatgcaatccagcatgtatctagtcgtaatgagtaattgcgggatgggaccaactactttgggtgtccgtgtttcctttttatccttattgattgcttatggtgacaatatatagtactatatattgacacc

SEQ ID NO: 518 - DNA, 492 bp, Chicken picornavirus 2
  isolate 44C, complete genome.1
caccccctactgccctaacccccaaagttagttatagggtggctccctacccttactccacggggtaagccctaacccggttgaatctcaagatcagccttagcgaggactattagtaccgctcaaaccctttgcctgtagtgcccaggggtcacagaggggtgaccctctccctggggcccaaaaggctaggtggcaagacagggtccaagtgaggggctactctaagtagccccaagctgaacatcctgtctgaagccacccttgcagggccaggtttgattggggaaactagacaccagctttgtcctgggattggggggatatcgagttagtccaggaggtgcgagtagatgcccccgaaggtaccccaggcacatctgggatctgatcgggggcccgtgactatacaataggtaaaccgggttaaaaaacatgaaagcgcctctctctttcctacttcttttattgactggtgacaaaaatagcagt

SEQ ID NO: 519 - DNA, 493 bp, Avian encephalomyelitis virus
  strain van Reokel, complete genome.1
tttgaaagaggcctccggggtatccggaggtcctttttcgacccaacccatactggggggtgtgtggggccgtatttggagtgcacggtatatatgcattcccgcatggcaagggcgtgccaccttgccccttgacgcatggtatgtgtcatcatttgccttggttaaaccccataaaacgaggcgccacgtgccgaaaatccctttgcgtttcacagaaccatcctaaccatgggtgtagtatgggaatcgtgtatgggggtgattaggatctctcgtagagggataggtgtgtcattcaaatccagggagtactctggctctgacattgggacatttgatgtaaccggacctggttcagtatccgggttgtcctgtattgttacggtgtatccgtcttgacacactgaaagggtattcttgggtaatcccttcctactgcctgatagggcggcgtgcccggccacgagagattaagggtagcaatttaaac

SEQ ID NO: 520 - DNA, 494 bp, Quail picornavirus QPV1/HUN/2010
  complete genome.1
tttgcatcagttcgcccctcccctcaccatacctttttcccctctttaggactgatacttggttatgatgagcagaggatttcgcaagttatgcttcttgataaaaagtaattcacgaatcatgggattatagcctggaagtgaacactcatgtggcaagtgggttagtagctctccatgttcccatgtgcagtggactgacaacagtgagttcggggttgtgtagtaaagggaaagtattacttacccgcacctgctatacgtggtgtacgtaggatacgagttagtagtgcttagcaactttaaactggtgctgaaatattgcaaggtcactgaagttgtgaacgcgaacgctccgccactgccatgtatagcgtgcaatgcataaatggtgcactacatgatacgagggaatgggaaaccctccatggccgaatgcagggtgacagcctgccggcggatgcctgttgttagtataatccgttgtttgccac

SEQ ID NO: 521 - DNA, 494 bp, Avian encephalomyelitis virus
  strain L2Z, complete genome.1
tttgaaagaggcctccggagtgtccggaggctctctttcgacccaacccatactggggggtgtgtgggaccgtacctggagtgcacggtatatatgcattcccgcatggcaagggcgtgctaccttgccccttgacgcatggtatgcgttatcatttgccttggttaagccccatagaaacgaggcgtcacgtgccgaaaatccctttgcgtttcacagaaccatcctaaccatgggtgtagtatgggaatcgtgtatggggatgattaggatctctcgtagagggataggtgtgccattcaaatccagggagtactctggctctaacattggcacatttgatgtaaccgaacctggttcagtatccgggttgtcctgtattgttacggtgtatctgtcttggcacactcacagggtatttttgggtaatcctttcctactatctgatagggtggcgtgcccggccacgagagattaagggtagcaatttaaac

SEQ ID NO: 522 - DNA, 494 bp, Human enterovirus
  strain NYS/2006/1999/CVB2 polyprotein gene,1
atcgagaaacctagtaccaccatgaaggttgcgcagcgtttcgctccgcacaaccccagtgtagatcaggccgatgagtcaccgcgttccccacgggtgaccgtggcggtggctgcgttggcggcctgcccatggggcaacccatgggacgcttcaatactgacatggtgtgaagagtctattgagctaattggtagtcctccggcccctgaatgcggctaatcccaactgcggagcagatacccacacgccagtgggcagtctgtcgtaatgggcaactctgcagcggaaccgactactttgggtgtccgtgtttccttttattttttgtactggctgcttatggtgacaattgagagattgttaccatatagctattgggttggccatccggtgtcaaacagagcgatcatctatttgtttgttggattcatacccttaaaccttaaagccctaaacactcttaattttgtgttgcaactgaactcagcaaa

SEQ ID NO: 523 - DNA, 496 bp, Bat picornavirus 3
  strain TLC5F, complete genome.1
taagcggaaagcattcttgtcccccggtcagtaacctataggctgttcccacggctgaaagggtgaacatccgttacccgcctcagtacttcgagaaacctagtacgcctgatgattccaaattggtatgatccggtcaaccccagaccagaaactgtggatgggggtcaccattcctagtatggcaacatacaggtgtccccgcgtgtgtcacaggcccttacgggtgccatttcggatgagtctggccgaagagtctattgagctactgttgatacctccggccccctgaatgcggctaatctcaaccccggagccactgggtggtgaaccaaccacttggtggtcgtaatgagcaattctgggacggaaccgactactttggggtgtccgtgtttcttttgttcatattaaactgttttatggtcacaacacaacttggtacgatttgtgattattcactgctcacttgtcacagtaaatatacacaatcatc

SEQ ID NO: 524 - DNA, 496 bp, Enterovirus Stuttgart 97
  polyprotein gene, partial cds.1
tacttcgagaaacccagtaccaccatgaaggttgcgcagtgtttcgctccgcacaaccccagtgtagatcaggtcgatgagccaccgcattccccacgggcgaccgtggcggtggctgcgttggcggcctgcccatggagcaatccatgggacgcttcaatactgacatggtgtgaagagtctattgagctaattggtagtcctccggcccctgaatgcggataatcctaactgcggagcagacgctagcaaaccagcgagtagtctgtcgtaacgggcaactctgcagcggaaccgactactttgggtgtccgtgtttccttttattctcatactggctgcttatggtgacaattgaagaattgttgccatatagctattggattggccatccagtgacaaatagagcaattgtctatttatttgtcggttttgtaccgttaaactacaaagttctaaacactctcaatcttgttttatcactcaatacatcaaa

SEQ ID NO: 525 - DNA, 498 bp, Simian pegivirus
  isolate SPgVkrtg_RT11 polyprotein precursor, gene,1
gcttcggcgcctagccgaaaccgacaccctgttcgaaatctttccgaaacatagagcggttgtggggaaactggacgaaagccagcggatggggggtgacagggtaggcaggtcgtaaatcccggcctccctggtacctggtataagtctggtggaaccatagcttaactgtgtggactttggacgtaggcagagtgcacggtccacaggtgacgcctataccggtgtgaataataggccgactcgagcggagtcgttaaactgaggacccattctaggatcacaacttggctgccgtacggtgacgccgctaaagtcacagtgggttaagtccggcgggttgacaacaccaggcaggcggggggacgctactgttgcgccctgtgagttccctagttgggtaggcatggggggacccagctccgcggcgcgctacagccggggtaggccaaaaatccgaaaggtgaggccgggtcccatttttcctttttgagtctc

SEQ ID NO: 526 - DNA, 498 bp, Pestivirus J
  isolate NrPV/NYC-D23 polyprotein gene, complete cds.1
gtataagggttgggaaccttgtaccaagctacctctgccattcagtatttgggagtagaagtagatgtgtttacaaactcacacgtgtgggggcggggatagactgtgccagcggtcgtgtaccagcacctacgcatacgtgtggactgcgaaccaggagagcacctaggtctgacaagctgtgagaacacagtagtcgtcagtgagtcagctggtaaggatcacccacctggatactcacgtggacgagggagtttcccagtcagaaacctacaccagaggaggggtcctctggagacatggatggtctgagtaacagactatctactggggtgtgctgcctgacagggtctcggctgatagcctggctagcagtataaaaatcagttgaattggcatatgagttgtgaacatctagtaaacaatgaaagacaaaaacaaaaaatgagcataataaaaaaattgtacaatccactactcaggtgtggctgcagactt

SEQ ID NO: 527 - DNA, 500 bp, Kunsagivirus 1
  strain roller/SZAL6-KuV/2011/HUN, complete genome.1
tttcaaatcggactccggtagttataccggagcccggtttggacgcttgggccgcgttaacagccccccacccctttcccactgactgatttctcggattggactcatttgcattgctaactctgattctggatttccccgtttatgtcgtcgcggtcggaagtgcacgtacttcgacgttgatctgatggcgtttgtttccaggggggaggtggcggcagaaacgcccccgccgtaaacttcggcgggccacgcctgtcaagccactccctggggccgagcgcctgaggtgatacagagagataagcacactgggcgctgacaacgcccgggacctcagtgagaagagcagtagggccgtgtttatgggactccattggatatcccccgcttgtcggaactcacggctactccgggttgggaagcccgcgactggtactgtactgggtgatagcctggtgccttccctctcactgttgtatgaaggctgaaaaccccct

SEQ ID NO: 528 - DNA, 501 bp, GB virus C
  Hepatitis G virus, isolate D50 polyprotein gene, complete1
accgacgcctatcaaagtaggcaataaggcctcgcgccgaaccggcgaccggccaaaaggtggtggatgggtgatgccagggttggtaggtcgtaaatcccggtcatcttggtagccactataggtgggtcttaaggggaggctacagtccctctagtgcctgtggagagaaagcgcacggtccacaggtgttggtcctaccggtgtgaataaggacccgacgtcaggctcgtcgttaaaccgagcccgttaaccccctgggcaaacgacgcccacgtacggcccacgtcgcccttcaatgtctctcttgaccaataggcaaagccggcgagttggcaagggccagtgggggccgggggcagggagaaggactccctgtcctgcccttcccgggggtgcgggaaatgcatggggccacccagctccgcggcggcctgcagccggggtagcccaagagccttcgggtgagggcgggtggcatttttctttcctataccgatc

SEQ ID NO: 529 - DNA, 502 bp, Human rhinovirus A
  strain HRV-A71_p1047_sR141_2008 polyprotein1
ctttgtgtttgagggccaataggtgagtggtaaaccataccactaaaaggtcaagcacttctgtttccccggtgtgcagggaataagctctacccgggctgaagccttaaacatcgttatccgcacaattactacgcaaagcttagtagtaccttgaaagctccttgactggtcgctccgctagattacccatctagtagacctggcagatgaggctggatactccccactggcgacagtgatccagcctgcgtggttgcctgcacacctggtaacaggtgtgaagccaatgagtagacagggtgtgaagagccccgtgtgctaattgtgagtcctccggcccctgaatgcggctaatctaaccccacagctaatgcatacaaaccagtatgtatttagtcgtaatgggcaactgtgggacggaaccgactactttgggtgtccgtgtttcctttattctcattattttgcttatggtgacaaatacgatatatttgtcatc

SEQ ID NO: 530 - DNA, 506 bp, Phacovirus Pf-CHK1/PhV
  complete genome.1
gtgtgtcatttctcccctccccctcccaaaccttttccccctctaatcggattgattaacccggttaaagatgattaatggtttgtgagttgatatgatggcccggcattgaatccgggaattcttaagtaatggaattgcatccaatatgaaagtgagtgtggcaagctcacaagtagtacttggctctgcccattatttgaggaccaactcttcttgactacaatgtgtttaaagtaaactggaccacattgtgtatccagacaactccatttgataatgtacgctggaaacgttttcagtgcatagggtcctaaagtggtgctgaaatattgcaagctcaatgggatactgaacgctgaaaaccgccgctgttatcatatgggcccctagtgggtaaatgttggctttaggcatatactgcttgggaatgcagtactggttgtagacagggtgatagcctaccggctggcgtagttgagttggtatagccagttgattgccat

SEQ ID NO: 531 - DNA, 506 bp, Seal picornavirus type 1
  isolate HO.02.21, complete genome.1
ttcaaaggtggcgggagagttggcctcacgctgtttagcgtgagagctggctctcctgccccttcccctgagccggggatcttggctcattcccctcttttctatcctccctcattggactttacggatgacccggcataaacttgacaaccgatgttggatttcccttgtggctgtgatggaggacataccctcgggtgtagttgtgtgcgtgtcgctctgcgactcgagcttcaaagtggtgctgaaatattgcaagcgtcgttgctcgattaacggagtggtacaatcctatgaacccaagtgcattcatgcgaaagccccggaggggtgagtagcatggactcgaatcagaagagctggagctcgcttggtacggcacgtagcattgctttgcctaaagaccaagggggtatggctataggtgggggcctatagcttgtccagtgctggttgacagactcgtgctacgcgtctggttcgagtataagtagctgcaactcact

SEQ ID NO: 532 - DNA, 508 bp, Unknown
  Description of Unknown: Crohivirus B clone Bat/CAM/CroV-P25/2013, polyprotein gene, complete1 sequence
gtataagagacaggtgtttgccttgtcttcggactggcatcttgggaccaaccccccttttccccagccatgggttaaatggcaataaaggacgtaacaactttgtaaccattaagctttgtaattttgtaaccactaagctttgtgcacataatgtaaccatcaagcttgttagtcccagcaggaggtttgcatgcttgtagccgaaatggggctcgaccccccatagtaggatacttgattttgcattccattgtggacctgcaaactctacacatagaggctttgtcttgcatctaaacacctgagtacagtgtgtacctagaccctatagtacgggaggaccgtttgtttcctcaataaccctacataataggctaggtgggcatgcccaatttgcaagatcccagactgggggtcggtctgggcagggttagatccctgttagctactgcctgatagggtggtgctcaaccatgtgtagtttaaattgagctgttcatatacc

SEQ ID NO: 533 - DNA, 509 bp, Bear picornavirus 1
  isolate CH-1, complete genome.1
gctcaggggaaggggtagggtggctggacgcccgccatacaggcgggctccaaccaccccaccccttcccctgagccggggttctttggctcatcccccttctttatctatctccctcatgtacggattaaactggcataaatttgatatcgatgttggattatcccttaaatggttttggtgggggacatagccccgggcgacctctagtcggacatgctggctttcctagattcaaagtggtgctgaaatattgcaagcgtcgtttctaggtaggttggtatgaatggctttagtgaacccaactgcaatcatttgaacgcccctgaggggttagtaaaatggactcacagctggagagctggagtgagtgcaccacggtacatagcattgctctacctatagggtgtacttgcatggctaagggtgggggcccttagcttgtccagtgctgggtgacagcctcgtgccacgcgctggcctgtgagtataagtggctgaatatcgct

SEQ ID NO: 534 - DNA, 510 bp, GB virus C
  isolate P187 polyprotein gene, partial cds.1
aagccccagaaaccgacgccccacggaatagtgggactaaggcccaatcaaagccaggaattccggccgaaagggtgtggatggtggtgacagggttggcaggtcgtaaatcccggccattctggtagcacctataggtgggttgaactggcggcgagaagtccctaatacctcttgcacgtgttgcgcacggtccacaggattggtctttccggtgtgaatagagacccgacgccagtcacgtcgttaaacagagtgcctttccccatcgcaacgccggccctcgtacgggaacgtcgcccttttaataccactctggtcagtagcatgtgcggcgagttggcaatcccagggggcgggcggggcgtacacggtaggaccgtgccgcctgcgttgtcggggtctggtattaatgcatggggccacccagctccgcggcggactgcagccggggtagaccaagatccttcgggtgaggtcgggtggcatctttctttctttgacatcatg

SEQ ID NO: 535 - DNA, 512 bp, Bovine picornavirus
  genomic RNA, complete genome, strain:1
ttttctcccctccccctccacttaccttttccccctcttgtaacgctagaagtttgtgcaaatcgcctgtagggtactgcaatccagcagtgcataggcaaagcttttcttgttaccccaccccacattatactgaggaggatggtgaaattgtgttagtatgggttagtagcggtgacccgggtaaccccaacccagaaactcacggatgagatgaacaggaccccacatggtaacgtgtgtgttcgtctgccccgcaaggtgaggccgtgagagctccgcacgcgaaaaccttgaaaacccaaaagtaccttgagctcttcgctattttgtgtttcctccaggaccctgaatgcggctaaacccaacccgcgatccgcacgtagcaacccagctagagtgtggtcgtaatgcgcaagttgcgggcggtaccgactactttggtgttcctgtgtttcctttattttattttaaatttttatggtgacaacagctggaaaataagagtgatc

SEQ ID NO: 536 - DNA, 512 bp, Bovine picornavirus
  genomic RNA, complete genome, strain:1
ttttctcccctccccctccccttaccttttccccctctagtaacgttagaagctagcactaaccgcctgtagggtactgcaatccagcagtgcataggcaaagtctttcttgtcaccccaaccccacactatactgaggaggatgacgaaatttgactagtatgggttagtaacggtgatccgggtgaccctgacccagaaactcacggatgaggtgaacagaaccccgcacggtaacgtgtgtgttcgcctgccccgcaaggtgaggccgtgagagctttgcacgtaaaacccctgaaagtccgagagtagtttgagctcttcgctattttgtgtttcctccaggaccctgaatgcggctaaacctaacccgcgatccacacatggcaatccagctagggtgtggtcgtaatgcgcaagttgcggacggtaccgactactttggtgttcctgtgtttcttttattttattttaaatttttatggtgacagcaatccagaaaagagataaac

SEQ ID NO: 537 - DNA, 512 bp, Picornaviridae sp.
  isolate sru051pic1 genomic sequence.1
gagtgcttgatttgtaatggaaaaagcaaagcttatccaaatacaaatcaagcacccgtttggggagttcaccgtccccttaattcataggtgattggactgattttgatactgatttaggatttcctttgacctggattgggataaagacttaaacatgttgaataaggatggattagctcgatccattaggtgggtctcatatataccaccacagagccggagaataaccttacaaaggatgttagtaattaaatacacttgttgggtggcgtaactgcagaccatgtggacatgggcctatgttgtggtaacacaatcccatgtggccaaaagcctagtggataacaatccacccatggtaatccaatttggacactcaacatttaagtgtttagtgaaagtatctgatggggtgacactctgtgagaacccagggagtagatgcccaggaggtacccttttaaaggatctgacttggggcctagacacttaatgctaggttaaaaact

SEQ ID NO: 538 - DNA, 513 bp, Simian pegivirus
  isolate SPgVkob_OB23 polyprotein precursor, gene,1
cctccccctcccccgaccggagcggaactccggaaaaccgacacctagtgaacatttcggatcattggcgcggatctggtgttaatctggacgaaagcccgtggacgggcggtgacagggttggcaggtcgtaaatcccggccgccctggtagcgggtataagtctggaggaaaccagtgaaccctcagtgtgaagtcagactaacgaaagtgcacggtccacaggagacgccgattccggtgtgaataatcggccgactcgagcggagtcgttaaactgaggacctccttggggatggcaacttggcttgcgtacgggaacgccgcaaaagtcacagtgggttaagtccggcgggttgacaatcccagcaaggcgggggggcactattgttgtgccctgccagttcccccaagggggtaggcatggggggacccagctccgcggcgcgctacagccggggtagcccaaaatccttcgggtgagggcgggtcccatgtcccttttttgtatgc

SEQ ID NO: 539 - DNA, 513 bp, GB virus C
  isolate G3825 polyprotein gene, complete cds.1
cccccccccggcactgggtgcaagccccagaaaccgacgcctactgaagtagacgtaatggtccagcgccgaactggcgaccggccaaaaggtggtggatgggtgatgacagggttggtaggtcgtaaatcccggtcatcctggtagccactataggtgggtcttaaagggaggttatggtccctcttgcgcatatggagggaaagcgcacggtccacaggtgttggtcctaccggtgtaataaggacccggcgctaggcacgccgttaaaccgagcccgttactcccctgggcaaacgacgcccatgtacggtccacgtcgcccttcaatgtctctcttgaccaataggcttagccggcgagttgacaaggaccagtgggggccccccccgttgcccttcccggggaggcgggaaatgcatggggccacccagctccgcggcggcctacagccggggtagcccaagagccttcgggtgagggcgggtggcatttttctttcctgtaccgatc

SEQ ID NO: 540 - DNA, 513 bp, Picornaviridae sp.
  isolate wftcra74pic2 genomic sequence.1
gttaggcatagacacctacgaggcccaggacatacgcaatttcaattgcgaaaatgccctgggccccgtaggtgtctatgcctaacttcaacgagtagtggccgtaagccactttctttctaaactctctaactctacattttcctccttgtttgcaggttttatggtcttaaacttggaacgcgaatgacgatgaaactggaacaactttctgattgggctacccgccttccaaccggcaatggtgtaaaggtaaaagggtagattgctaccacttatggcatgtgaactggattaccaatgtagcatggaccctctaggtggggaatggcaatcgactatcctagctagattggaccactcatgggctttgggcgcgaattacgcagaacctaccgacaacatgtctggaaaccccatgagtggaggggaattgggaaaacccctttgatccaaactgcctgatagggtcgcggctggccgagttaggattagtagtcagtagaatttaac

SEQ ID NO: 541 - DNA, 516 bp, Rosavirus M-7
  polyprotein gene, complete cds.1
tatgcatcactggacggcctaacctcggtcgtggcttcttgccgatttcagcgctaccaggctttctggtctcgccaggcgttgattagtaggtgcactgtctaagtgaagacagcagtgctctctgtgaaaagttgatgacactcttcaggtttgtagcgatcactcaaggctagcggatttccccgtgtggtaacacacgcctctaggcccagaaggcacggtgttgacagcaccccttgagtggctggtcttccccaccagcacctgatttgtggattcttcctagtaacggacaagcatggctgctcttaagcattcagtgcgtccggggctgaaggatgcccagaaggtacccgcaggtaacgataagctcactgtggatctgatctggggctgcgggctgggtgtctttccacccagccaaaacccgtaaaacggtagtcgcagttaaaaaacgtctaggccccacccccccagggatggggggttcccttaaaccctcacaagttcaac

SEQ ID NO: 542 - DNA, 517 bp, Crohivirus A
  gene for polyprotein, complete cds, strain: ZM54.1
gttgaagtccatttcttgcttgcccccgatgaatcctgttaaggcctcacggccctaagggtgaaactcggttatcccctcctgtacttcgagaagattagtacaacactatgaaatctacatcttgtgatccgggataaccccaatcccagaaacctgtgatgggcgtcaccacccctcttatggtaacataagggtgtcgccgcgttggcacaggaccctttgggctggatgtttttagtaatggtgtcgaaggtcctattgagctacaggagtttcctccgccctggtgaatgcggctaatcttatccctgagcctaaggttgcgatccagcaacttgatggtcgtaatgcgtaagttgggggcggaaccgactactttccagaaggcgtgtttctttgttttgtctgttactatggtgcatgatatagatattgaatatttgatctttttgagctgtttcttatcttattgctacatcctttcaggtgttggatttacattttggttaataag

SEQ ID NO: 543 - DNA, 518 bp, Foot-and-mouth disease virus
  type SAT 2, isolate SAT2/EGY/24/20141
gacgtcagcgcacgaaacgcgccgccacttcggaacactcgtacaaacacgatcacacgcgggtttcccaactggcatcctcgtgcaacctggagtttcgcctggtctttccaggtctggagagatgacacgttgtactggaaccaactccacgatcggtctactggcgggtgctagtaacgacattgttgcttcgtagcggagcatgcaagccgtgggaactcccccctggcaacagggacccacggggccaaaagccacgttctccgaaccttgcatgtgtgcaaccccagcacggtaacactgttgtgaaacacgctttaaggtaacactgagactggtacttggtttctggggacaggctaaggatgccctccaggtaccctgaggtaacaagcgacactcgggatctgaggaggggactgggacttctataaaagtgcccagtttaaaaagcttctatgcctgaataggtgaccggaggccggcaccttttccttttacacacaaaccactac

SEQ ID NO: 544 - DNA, 518 bp, Encephalomyocarditis virus
  strain 1086C polyprotein gene, partial1
ccggtgtgcgtttgtatacatgttacttccaccacgttgtcgtcttttgacaacgtgagggcccggaacctggccctgtcttcttggcgagtattcctaggagtctttctcctctcgacaaaggaatacaaggtctgttgaatgtcgtgaaggaagcagttcctctggaagcttcttgaagacaagcaacgtctgtagcgaccctttgcaggcagcggaatcccccacctggtaacaggtgcctctgcggccgaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtactccactggctggaatctgatctggggcctcggtgcacgtgctatacacgtgttgagtcgaggttaaaaaacgtctaggccccccgaaccacggggacgtggttttcctttgaaaaccacgaagataat

SEQ ID NO: 545 - DNA, 520 bp, Foot-and-mouth disease virus
  type SAT 1, isolate SAT1/ZIM/22/891
gggacgtcagcgcacgaaacgcgctgttgctctttgcattcttgtacaaacacgatctcacgcaggaatcttagaccaacccaacccgtgcaactgcaagtttcacccggtctttccgggcctagagagacgaacagctgtactgagactgactccacgatcggtctactagcgggtgctagtaacactcactttgcttcgtagcggagcacatgagcggtgggaacccccccatggtaacatggacccaccgggccaaaagccacgcctcacggcctcatgtgtgtgcaaccccagcacggcaacttgtttgtgaaacacatcttaaggtaacactgagactggtactcggtttctggagacaggctaaggatgcccttcaggtaccccgaggtaacaagagacactcgggatctgagaaggggaccaggagttctttaaaactgcttggtttaaaaagcttctatgcctgaataggtgaccggaggccggcaccttttcctttatccacaacaacttt

SEQ ID NO: 546 - DNA, 520 bp, Human enterovirus C105
  strain BU5 polyprotein gene, complete cds.1
ccagtgtggtttcgagcaagcacttctgtttccccggccgcgccctatatgctgtgcaaacggcagaaaggggcaacgtcgttacccgcttgcatactacgggaaacccagtaccaccattgattgtattgagagttgcgttcagcgcctctcccccctggcgtagctcgggccgatgaggctcagaagcccccacaggtgactgtgtctgagcctgcgttggcggcctgcccgcacctcttggtgtgggacgcttaatacatgacatggtgcgaagagtctactgtgctatgtaagattcctccggcccctgaatgtggataatcctaaccactgatcccatgtgcgcaaaccagcgtgcggtgggtcgtaacgcgcaagtcggtggcggaaccaactactttgggtgtccgtgtttcctttattacctattgaatgtttatggtgacaattgcttgattcagttgttgccatttattacattcgttgacctagactgaaaaccaactgaaccattaca

SEQ ID NO: 547 - DNA, 522 bp, Rabovirus A1
  strain HT5, complete genome.1
ccgggtataacccggagttttggggcaggtccaagccccacataggaacatacgatccacggatcgtgtgttcttttatgctttctaaccttaccctttgtaaccattacgctttacgccgcatggtgtttggcggcaccatgacgtggacaagaggttacgccattacgatatgtaccctccccttttggggagagaccgaccaattatggtacagtatccaactgtattgtggtcaagtacttctgtttccccggtgatgcgggataggctgtacccacggccaaaacctgctgatccgttacccgactcacatctacgaggaggctagtaaaaggcatgaagttcaagagtatgatccaaccagatccccactggtaaactagtgatgagggttcccgttccgaacatggcaacatgtgggttccctgcgttggcactaggccccttccgaggggtgctctgaagatggattgttgatgaagaccaatttgtgcatgtgtttatcctccggccctctga

SEQ ID NO: 548 - DNA, 523 bp, Simian pegivirus
  isolate SPgVkrc_RC58 polyprotein precursor, gene,1
ggggaatctcacccccccccgtccggttccggaagaatcggaaaccgacaccctgaccaatcattcttgatcatagagtggatgttagtgaaagccagacgaaagccggcggatgggtggtgacagggttggtaggtcgtaaatcccggccaccctggtacccggtataagttgggcggaagctgactgaagctccgtgctcttttctgtgcgttcttggtgcacggtccacaggtgacgcctataccggtgtgaataataggccgactcgagcggagtcgttaaactgagaacctccatacggatggcaacttggcttgcgtacggggacgccgctaaagtcacagtgggttaagtccggcgggttgacaaccccagcaaggcgagggggtcctattgttggactctgccagttcccggtggaggtaggcatggggtggcccagctccgcggcgcgctacagccggggtagcccaaaatccgaaaggtgagggcgggccacatgtccgaaatttagtcaagc

SEQ ID NO: 549 - DNA, 523 bp, Echovirus E19
  strain HAI/2016-23036E polyprotein gene, partial cds.1
ggaaaaaacgtccgttatccggccaattacttcaagaaacccagtaccaccatgaaggttgcgcagcgtttcgctccgcacaaccccagtgtagatcaggtcgatgagtcaccgcattcctcacgggcgaccgtggcggtggctgcgctggcggcctgcccatggggcaacccatgggacgcttcaatactgacatggtgcgaagagtcaattgagctaattggtagtcctccggcccctgaatgcggctaatcctaactgtggagcagattcccgcatgccagcgggtggtctgtcgtaacgggcaactctgcagcggaaccgactactttgggtgaccgtgtttccttttattcctatattggctgcttatggtgacagttgagagattgttaccatatagctattggattggccatccggtgacaaacagagcaattatctaccaatttatcggttttgtaccattgaatttcaacgcattcaaaaccctcaactttattttgactcttaatacagcaaa

SEQ ID NO: 550 - DNA, 524 bp, GB virus C
  isolate UU1, complete genome.1
cactgggtgcaagccccagaaaccgacgcctatctaagtagacgcaatgactcggcgccgacccggcgaccggccaaaaggtggtggatgggtgatgccagggttggtaagtcgtaaatcccggtcatcttggtagccactataggtgggtcttaagggaaggttaagattcctcttgtgcctgtggcgagacagcgcacggtccacaggtgttggccctaccggtgtgaataagggcccgacgtcaggctcgtcgttaaaccgagaccgacacccacctgggcaaacgacgcccacgtacggtccacgtcgcccttcaatgtctctcttgaccaataggctttgccggcgagttgacaaggaccagtgggggccggggacgggggggagggacccccccgccccgcccttcccggtgggacgggaaatgcatggggccacccagctccgcggcggcctgcagccggggtagcccaagagccttcgggtgagggcgggtggcatttttcctttctgtactaatc

SEQ ID NO: 551 - DNA, 524 bp, Carp picornavirus 1
  isolate F37/06, complete genome.1
agctacaggaaagagagagataatcacagcacataaatacaactacagaagagagcctttccctgagcactatttacagcaaaccacgctgggaaaagtggtagcatgacccacttacgggttacttagtataggattttaatatcttcgattctttattttcttttcttaactaagttcgcccggactttatccgtgttttattttagtttaagcaaaattgagtaactaagtttttaacctgccaaatggtgagaagtaactctgtgaaaataccatttgtgcatgaaattgtcttgaaaactcttaggcttttggggggtcccactgctgtttggaggactattgacagactctattgtagttgagtagtgactaatgataacgatttgcgtattacgcaatgggctgtacccgttagatttagtatgccggggggaggggtcccactggattgcactatgtaacctgacagggcgtctgccgacgcactacaatgaggataagatcggctgtttttattt

SEQ ID NO: 552 - DNA, 527 bp, Human pegivirus
  isolate GBV-C-ZJ-180501, complete genome.1
cccggcactgggtgcaagccccagaaaccgacgcctatttaaacagacgttatgaaccggcgccgacccggcgaccggccaaaaggtggtggatgggtgatgccagggttggtaggtcgtaaatcccggtcatcttggtagccactataggtgggtcttaagggttggtcaaggtccctctggcgcttgtggcgagaaagcgcacggtccacaggtgttggccctaccggtgtgaataagggcccgacgtcaggctcgtcgttaaaccgagcccattacccacctgggcaaacaacgcccacgtacggtccacgtcgccctacaatgtctctcttgaccaataggctttgccggcgagttgacaaggaccagtgggggctgggcgacgggggtcgtataggaagaaaaatgccacccgccctcacccgaaggttcttgggctaccccggctgcaggccgccgcggagctggggtagcccaagaaccttcgggtgagggcgggtggcatttttcttcctataccgatc

SEQ ID NO: 553 - DNA, 527 bp, Bat hepatovirus
  SMG18520Minmav2014 polyprotein gene, complete cds.1
ttcaaaagccccagcggggtttcattaccccgctgtggcttttggacttccctaggatggggaagtaaattaccatcctcgcgtttgccgtgcgttaacggctacttttcttctagctgtagaagtaaaattcagcatgttttatgtttgtttgtcttgtttgttatatacatttttacactcctacaaatgcacatgaagaacagtttgtagagattaacaaacgcttagctgaacctaggtggtgaatctagtagtaagataagtagaggaagctataccttaagttggttgggccctcgtgtttgctctataaacaaaaccaagtgagtagagtggatgaacagtactaaatccctgagtacagggaacctcacaggtgtgatacacttatgtctatgtgacctggttggaggttgggcgtgccctatgatactggagtgggagatcttttggggaacccacgttttcacactgcctgatagggtcttgccgagagactcacttgtttcggctgtacttgtaac

SEQ ID NO: 554 - DNA, 527 bp, Picornaviridae sp.
  isolate ecw123pic1 genomic sequence.1
gggctacacatgtgataccatgttctagcatggaaaatcacacatgcagcccgatttcgggcttgggaacccgttcatcaagatcccataacctttcttttcttttgtctatcccttgagtagctaggctcgcggcagggtcttgtatatacctgcactagctgccacgaagtgctacagaaaccattagtatatatttagaaaccacctgttgacgtaactgtgattgattgcctggggctgagggcatggtaacatgcaccccaggggccaaaagcctagtgggtaacaacccaccattcatgatgcccttcttggcacaacaagtggatctctctatctatagaacatgggagtatggtatggagtggtgtaaggagcacgctagtagatgccccataggtacccttctggatctgagtgggggccatgaggaggtctttccctctgaattggttaaaaaccatgaacgtttgctccgcccatctttcttctaattttatcaacttacttgaattctgatcaca

SEQ ID NO: 555 - DNA, 528 bp, Hepatovirus A
  isolate KibOB-1, complete genome.1
cttttcacgctttctgtcatcttatttcctgggctctccccttgcccaaggctctggccgttgcgcccggcggggtcaactccatggttagcatggagctgtaggagtctaaattggggacgcagatgctgggaacgtcaccctgcagtgttaacttggctttcatgaagctctttgatcttctacaagaggtaggctacgggtgaaacctcttagattaatactcctatggagagatatcttgaatagggtaacagcggtggatattggtgagttcctttgggacaagaaccattcaacaccggaggactggctctcattcagtagttgcattgagtgaattgtctgtcagggctgtctctgggtttaattcctggcctctctgtgcttagggcaaaccatttcctggccttaaatggagttctgtgagaggggactcctcctttatatgctggacatattttggggccttagggttctggtttgcctctgaggtactcaggggcatttaggtttttcctcacttat

SEQ ID NO: 556 - DNA, 529 bp, GB virus C
  isolate 62-11, complete genome.1
ccccccggcactgggtgcgagccccagaaaccgacgcctatcaaagtagacgtaatggccctgcgccgaaccggcgaccggccaaaaggtggtggatgggtgatgacagggttggtaggtcgtaaatcccggtcaccttggtagccactataggtgggtcttaaggctaggtaatggtccctcttgcgcttatggcgagaaagcgcacggtccacaggtgttggtcctaccggtgtaataaggacccggcgctaggcacgccgttaaaccgagcccgttatccccctgggcaaacgacgcccacgtacggcccacgtcgcccttcaatgtctctcttgaccaataggcttagccggcgagttgacaaaggccagtgggggccgggcgtagagggaaggaccctctgcgctgcccttcccgggggagcggtaaatgcatggggccacccagctccgcggcggcctacagccggggtagcccaagagccttcgggtgagggcgggtggcatttttctctcctataccaatc

SEQ ID NO: 557 - DNA, 529 bp, Simian sapelovirus 2
  strain VRDL1 polyprotein gene, complete cds.1
ctgacctgtttatgaacatgagcagcggcactgctccacgggctatccgtgtaagaaatattgattattcttatggatcatgatttcagggttggccgcccagtctaaaaggcaattgtggtaagctatgtaagtagttggctgttgaaaggagccaagtacatcctaggtctacgctgtgcgggccgaagtaagacttggaacaactctgagtaggcagtttttctctttagcccaacacgaccgcatactgaagagctagaggcactttggggcaaaggtaaaagcattgcttagaccgaatgttcaatgagaccttgacgagtgctgtcacagtgtcccctgatggcagtatggcgcatgctcttggcattacccatatgtgtatctatagggggggggccccctatacttagtctagtgctacctgacagggccgcggctggtcgtcggtgtgtggtataaccagtagtaatcccccatggattgctttaactccccctcctccctcaacaaaactttctctaag

SEQ ID NO: 558 - DNA, 529 bp, Encephalomyocarditis virus
  isolate KNP/17/94 5' UTR; and1
ttggaataagaccggtgtgcgtttgtctatatgttgcttctactacactgttgcctgtgacagtgtaagggcccagaacctggccctgtcttctcgacgagtgttcctaggggtctttcccctcttgacaaaggaatacaaggtctgttgaatgtcgtgaaggaagcagttcctctggaagcttcttgaagacaaacaacgtctgtagcgaccctttgcaggcagcggaatcccccacctggtaacaggtgcctctgcggccaaaagccacgtgtataagatacacctgcaaaggcggcacaaccccagtgccacgttgtgcgttggatagtttcggaaagagttaaacggctctccccaagcgtattcaacaaggggctgaaggatgcccagaaggtaccccactggttgggatctgatctggggccccggtgcacgtgctttacacgtgttgagccggggttaaaaaacgtctaagcccccctaaccacggggacgtggttttccttttgaaaaccacgataacaat

SEQ ID NO: 559 - DNA, 529 bp, Rhinovirus B
  strain 20692_33_HRV-B polyprotein gene, partial cds.1
ccccccacctaacatatccaagtaacttagaagatttgaacactgcacaatagggactattgcaaccagcaatagtcagtgcaagcacttctgtctccccggagcggagtatagacggccaccgctgtcaaaagctcttaaccgttatccgccagttaactacgcaacagctagtaacatcttgttgttcttagggtgttcgatcaggtgagtttaccccctcactagtctggtcgatgaggctgagaaatccccacgggtgaccgtgtctcagcctgcgtggcggccagcccagcatatgctgggacgccttaagtatgacatggtgtgaagactcgcgtgtgcttagctgtgagtcctccggcccctgaatgcggctaacctaaaccccggagccttgaggcacaatccagtgcccgcaaggtcgtaatgagtaattctgggacgggaccgactactttgggtgtccgtgtttccttttatctttttgatgttcttatggttacaatatatagagtatattgtaatc

SEQ ID NO: 560 - DNA, 529 bp, Human rhinovirus C
  strain HRV-C36_p1093_sR548_2008 polyprotein1
cccccctccttaatgtaacttagaagcttgaacaatcgcccaataggatatgaccactccatggttatgaagggcaagcacttctgtttccccgggtgtgtgaataggctctaacagggctgaagctgtagcactcgttatccgcgcatctactacgcagaggttagtagggccatgtcaatcctttaggcgtttcgctcagcgtgtacccccacgtagatcagggcaatggggctacacattccccatcggcgacgatggtgtagcccgcgtggtgccccgcctaggcctatttggcctaggacgccaaaggaaagacagggtgtgaagacccgagtgtgctaggtgtgagtcctccggcccctgaatgtggctaatcctaaccccgtagccatggtgtacaagccagtacaaacatggtcgtaatgggcaactatgggatggaaccaactactttgggtgtccgtgtttctctttttaccctttactgcatttatggttacaagcttgtgaatacagacttgtaatc

SEQ ID NO: 561 - DNA, 530 bp, Human pegivirus
  gene for polyprotein, isolate 56330272.1
cccccggcactgggtgcaagccccagaaaccgacgcctactaaagtagacgtgatggccccgcgccgaaccggcgaccggccaaaaggtggtggatgggtgatgccagggttggtaggtcgtaaatcccggtcatcttggtagccactataggtgggtcttaaggggaggtaaaggtccctctcgcgcttacggagggaaagcgcacggtccacaggtgttggtcctaccggtgtaataaggacccggcgataggcacgccgttaaaccgagcccgtaagccccctgggctaacgacgcccacgtacggtccacgtcgcccttcaatgtctctcttgaccaataggcttagccggcgagttgacaaggaccagtgggggccgggcgagggggggaaggaccccccctcgctgcccttcccgggggttgcgggaaatgcatggggccacccagctccgcggcggcctacagccggggtagcccaagagccttcgggtgagggcgggtggcattttttttcttgtaccgatc

SEQ ID NO: 562 - DNA, 530 bp, Rosavirus B
  strain RNYL1109081R polyprotein gene, complete cds.1
ggagtgtcttaagtgatcccctccagtctctttagtgcctatgcttcagagagcggtgaactgacaccgttgcttcttgcacagcccttcgtgccggtctttccggttctcgacagcgttgggcatcatggctagttaggctaagatggcaaatgatctggtgaaaagttttggattgtttggagctttgtagcgatgctagtagtgtgtgtggatctccccacgtggtaacacgtgccccacaggccaaaagccaaggtgttaaaagcacccctactagtcccagatacccccatctgggagctcctctcatgaaaaatcttagtaccctttgatttggctgttcatcaacctctctagtcaagggctgaaggatgcccggaaggtacccgcaggtaacgataagctcactgtggatctgatccggggccctggtgcgaccgtctgtccggcgtagctagggttaaaaaacgtctaggcccttccaccccaagggattggggtttccccaatcattttagaagttcact

SEQ ID NO: 563 - DNA, 530 bp, Rhinovirus A
  isolate E0-163 polyprotein gene, partial cds.1
cttccgatctcctaaagtaacttagaagttgagcacaatgaccaataggcgacatttctccagaatgtcaaaggtcaagcacttctgtttccccggtcaaggttgatatgctccaacagggcaaaaacagctgcgatcgttatccgcaaagcaactacacaaagcctagtatcacttttgagaatgtatggttggtcgctccactataaacccaatagtagacctggcagatgaggctagaagttccccactggtaacagtgttctagcctgcgtggctgcctgcgtgctccttgtgggcacgaagccatatatttgacaaggtgtgaagagccccgtgtgcttgttttgattcctccggcccctgaatgtggctaaccttaaccctgcagctagcgtgtgcaatccagcacaaagctagtcgtaatgagcaattgcgggatgggaccaactactttgggtgtccgtgtttcttgtttttcttttatacttgcttatggtgacaatatatataatatatatattggcatc

SEQ ID NO: 564 - DNA, 531 bp, Human pegivirus
  isolate NIG-N3559, complete genome.1
ccccccggcactgggtgcgagccccagaaaccgacgcctatcaaagtagacgttatggccccgcgccaaactggcgaccggccaaaaggtggtggatgggtgatgacagggttggtaggtcgtaaatcccggtcatcctggtagccactataggtgggtcttaaagggaggctacggtccctctagcgcttatggagagaaagcgcacggtccacaggtgttggtcctaccggtgtaataaggacccggcgctaggcacgccgttaaaccgagaccgttatccccctgggcaaacgacgcccatgtacggcctacgtcgcccttcaatgtctctcttgaccaataggcagttctgccggcgagttgacaagggccagtgggggccgggcggcgggggaaggacccccgtcgctgcccttcccgggggagcggtaaatgcatggggccacccagctccgcggcggcctacagccggggtagcccaagaaccttcgggtgagggcgggtggcattttctttcctataccgatc

SEQ ID NO: 565 - DNA, 531 bp, Rhinovirus C
  isolate E0-41 polyprotein gene, partial cds.1
accgcctattggtctttgtgtaaacttctaagttacgcaaaagggaaggggtggcaaatccataccactaacggtcaaacacttctgtttccccggcatgcgaggaataggctccaaaagggctgaagccactagtgtcgttatccgcattggtactacacaaagcctagtattaccttgaaaatttcttggctggtcgttccaccagataccccgctggcagacctggcagatgaggcaggacttaccccactggcgacagtggtcctgcctgcgtggctgcctgcacaccccttacggggtgtgaagcccagaaacagacagggtgtgaagagccccgtgtgctaccaatgagtcctccggcccctgaatgcggctaatcttaccccatagctgttgcacgcaaaccagcgtgtatgcagtcgtaatgagcaattgtgggatggaaccgactactttgggtgtccgtgtttctttttattcctattatttgcttatggtgacaatattgatattatcagtgttgtcatc

SEQ ID NO: 566 - DNA, 532 bp, Bakunsa virus
  complete genome.1
ttttgaacgccacctcggagcgatatccggggaccccctcccctttttccttcctaccttcttcccaaatttccctcttcccttgttattttggtttggatttcctggacatgactcggacggatctatctcatttgctttgtgtctgctccaccagtggcatggtcgaaagatcatcaacactggacgtgtactgtaatggccaaacgtgcccacaggggaaaccatgccggtcgctgtagcggcgggtggacgtggtggacccctctccctgctcataaactttgggtaggtgaagggttcaagcgacgcttgccgtgagggcgcatccggatggtgggaaccaacaaactaggctgtaatggccgacctcaggtggatgagctagggctgctgcaccaaaagggactcgattcgatatcccggcctggtagcctagtgcagtggactcgtagttgggaatctacgactggcctagtacagggtgatagccccgtttcccacgcccacctgttgtagggacacccccccc

SEQ ID NO: 567 - DNA, 532 bp, Human rhinovirus A
  strain HRV-A20_p1169_sR1200_2009 polyprotein1
cccctaccccttttatgtaacttagaagttttgtacacaccgaccaataggtggtatttaaccaaaataccaaaggtcaagcacttctgttaccccggtcaagattgatatgctctaccagggcaaaaacaatcgcgatcgttacccgcaaagcaactacgcaaagcctagtatcatttttgatggtgtatggttggtcgttccgctatgaacctgatagtagacctggcagatgaggctagaaaatccccactggtaacagtgttctagcctgcgtggctgcctgcgtaccccttgtgggtacgaagccgtacatttgacaaggtgtgaagagccccgtgtgcttgctttgagtcctccggcccctgaatgtggctaaccttaaccctgcagctagtgtgcacaagccagtgcatagctagtcgtaatgagcaattgcgggatgggaccaactactttgggtgtccgtgtttcttgtttttcttttatatttgcttatggtgacaatatattcaatacatatattgacacc

SEQ ID NO: 568 - DNA, 533 bp, GB virus C
  isolate EM110 polyprotein gene, complete cds.1
cccccccccggcactgggtgcaagccccagaaaccgacgcctactgaagtagacgtaatggtccagcgccgaactggcgaccggccaaaaggtggtggatgggtgatgacagggttggtaggtcgtaaatcccggtcatcctggtagccactataggtgggtctaaaagggaggttatggtccctcttgcgcatatggagggaaagcgcacggtccacaggtgttggtcctaccggtgtaataaggacccggcgctaggcacgccgttaaaccgagcccgttactcccctgggcaaacgacgcccacgtacggtccacgtcgcccttcaatgtctctcttgaccaataggcttagccggcgagttgacaaggaccagtgggggccgggcgggagggggaaggacccccaccgctgcccttcccggggaggcgggaaatgcatggggccacccagctccgcggcggcctacagccggggtagcccaagagccttcgggtgagggcgggtggcatttttctttcctgtaccgatc

SEQ ID NO: 569 - DNA, 533 bp, GB virus C
  isolate Hu_5, complete genome.1
cccccccacggcactgggtgcaagccccagaaaccgacgcctatctaagcaggcaataaggcctcgcgccaaaccggcgaccggccaaaaggtggtggatgggtgatgccagggttggtaggtcgtaaatcccggtcatcttggtagccactataggtgggtcttaaggggaggctacagtccctctgtcgcccgtggcgagaacgcgcacggtccacaggtgttgaccctaccggtgtgaataagggtccgacgtcaggctcgtcgttaaaccgagcccattatccccctgggcaaacgacgcccacgtacggtctacgtcgcccttcaatgtctctcttgaccaataggcaatgccggcgagttgacaaagaccagtgggggccgggggtgagggagaaggactccccaccctgcccttcccgggggagtgggaaatgcatggggccacccagctccgcggcggcctgcagccggggtagcccaagagccttcgggtgagggcgggtggcattttctttcttataccgatc

SEQ ID NO: 570 - DNA, 533 bp, Picornaviridae sp.
  isolate ybb150shi01 genomic sequence.1
ccttttaacgtaccgtagcacgttagctacaaacttagcatttattttattttaattctaaatttattttaatttacataatttcggctctagtaacaaaaaccttattatcgtatttatacgaacagcatttattatttaatacatatccttatttttaaattacaaatacataccccccttttaacttactataattgctaatcaccaacaaccttcaaatttgatctagtacacattttaaaattccgtttctaaattttattaacttgcatctttgattataactctgggagtctattcagacttggcaaacccttgagcagccctcaaaatttgtagaacacctcaggcgatcttttaatacatgacccctgttgtaataacgtattactgaaaacacaaacacaactgaattaacagaagacattaatacaacccaagaacaacaatttactttcgataaccaacgcacagttaagacagaaaactcttatctgttgcctccaataaattcaatttcggctcagaaa

SEQ ID NO: 571 - DNA, 534 bp, GB virus C
  isolate Hu_21, complete genome.1
cccccccccggcactgggtgcaagccccagaaaccgacgcctactaaagcaggcattaaggcctcgcgccgaaccggcgaccggccaaaaggtggtggatgggtgatgccagggttggtaggtcgtaaatcccggtcatcttggtagccactataggtgggtcttaaggggaggctacagtccctctattgcccgtggcgggaacgcgcacggtccacaggtgttggccctaccggtgtgaataagggcccgacgtcaggctcgtcgtaaaaccgagcccgttgtctccctgggcaaacgacgcccacgtacggctcacgtcgcccttcaatgtctctcttgaccaataggcttagccggcgagttgacaagagccagtgggggccgggggtgagggggatggaccccccaccctgcccttcccgggagagcgggaaatgcatggggccacccagctccgcggcggcctgcagccggggtagcccaagaaccttcgggtgagggcgggtggcattttcttttcctgtaccaatc

SEQ ID NO: 572 - DNA, 534 bp, Human rhinovirus 23
  complete genome.1
ccaaagtagttggtcccgtcccgcatgcaacttagaagctttgcacaaagaccaatagccagtaatcatccagattacttaaggtcaagcacttctgtttccccggtcaaagttgatatgctccaccagggcaaaaacaactgcgatcgttatccgcaaggcgcctacacaaagcttagtagcattctgaaagttgtctggttggtcgttccaccattccccctggtagacctggcagatgaggctagaaactccccactggcgacagtgttctagcctgcgtggctgcctgcacaccctctgggtgtgaagccatacgatggacagggtgtgaagagccccgtgtgctcgctttgagtcctccggcccctgaatgtggctaaccttaaccctgcagctagagcacacaatccagtgtgtttctagtcgtaatgagcaattgcgggacgggaccaactactttgggtgtccgtgtttccttgttctctttgaatatctgcttatggtgacaatatatacgtatatattgacacc

SEQ ID NO: 573 - DNA, 534 bp, Enterovirus D68
  isolate TOp-15-Ph068 polyprotein gene, partial cds.1
tttcaaatcaaagctcaataggtggggcacagacgtgcgcattaagtctcaagcacctctgtttccccggtgtggttgtataaactgttcccacggttgaaaacaacctatccgttatccgctatagtacttcgagaaacctagtatcacctttgaattgttgacgcgttgcgctcagcacactaacccgtgtgtagcttgggtcgatgagtctggacgtaccccactggtgacagtggtccaggctgcgtcggcggcctactcatggtgaaaaccatgagacgctagacatgaacaaggtgtgaagagtctattgagctactatagagtcctccggcccctgaatgcggctaatcctaaccatggagcaagtgttcacaggccagtgagttgcttgtcgtaatgcgcaagtctgtggcggaaccgactactttgggtgtccgtgtttcactttttacttttatgactgcttatggtgacaatttgatattgttaccatttagcttgtcaaattaattgcaaaagatcctaagt

SEQ ID NO: 574 - DNA, 535 bp, Rhinovirus C
  strain 20692_51_HRV-C polyprotein gene, complete cds.1
ccccgtttccatttacacccaaccctatgtaacttagaagcagtacactggaccaataggtggtaacaatccatgttgccaaaggtcaagcacttctgtctccccggcatgcgtggaataaacagtgcaaacggttgaaaccacaaatgtcgttatccgcgcatgaactacgcagagcctagtatctccctgaaaatctgttggttggtcgttcagctaatccccatagtagacctggcagatgaggcaagacgcaccccactggcgacagtggtcttgcctgcgtggctgcctgcacacccccccccggggtgtgaagccaattgatagacagggtgtgaagagccgagtgtgcttcatgtgagtcctccggcccctgaatgcggctaatctaaccccgcagctgtggcacacaagccagtgtgtatgcagtcgtaacgggcaactgcgggacggaaccgactactttgggtgtccgtgtttccttttattcttttatcaggtacttatggtgacaatagtgaatattgttacc

SEQ ID NO: 575 - DNA, 537 bp, Picornaviridae sp.
  isolate yc-6, complete genome.1
gccatccgtaggttctggtaaggttccatcaactgttggggcgctagttgctatgaccgcattcacggacggatgatttatagtatcacccaatccgggcacaacttctttagccacttcttccacattactaagggctctcttgccgagtttcaacgtctagtccacgacacggaccttcctacttttctatcttcttattttctctactaaattggtatctggtactgaagatatgcggattgtgattttgtgcctgtctaaactaaccctattctagggttaggtgggtaccatatactaatggtgaacaggattacctatgtatccattagtccctatggatctggcgacccacaaactcatgttcatagagaggctaagctgagtgctcgccgaataagcattgcttcaggtgccgactattgtctggaaaccactcagtgatagctataggggggggccccgtagcatctgccttactgcctgatagggtggcggctggtccatgaacatgcagtaaccagttgacttgac

SEQ ID NO: 576 - DNA, 538 bp, Rosavirus C
  strain NFSM6F polyprotein gene, complete cds.1
cagggagatctccatgaataatcttttccaccctctttagcgtctatgctattgaggacgggttggagccccgttgacccagcgtcagagtgtgtcggtagcaggctttctgctctcgccccatgccggccacacctcccattagtgatgtgaaggttgtaagttacatgtgaaaaggtttctaataattgagctgaatgtagcgattacctaaggtgagcggattcccccacgtggtaacacgtgcctctcaggccaaaagccaaggtgttaaaagcaccccttaggtaggccactaccccgtggcctcagttctcttagaagattcacttagtagtgtgtgcactggcaactcttaagcagagctagtgagtgggctaaggatgccctgaaggtacccgcaggtaacgttaagacactgtggatctgatcaggggctcgagtgctgaagctttacagaggtagctcgagttaaaaaacgtctatgcccctcccccacgggagtgggggttcccccacaccaattttagattgcact

SEQ ID NO: 577 - DNA, 539 bp, Bovine rhinitis A virus 2
  isolate H-1 polyprotein gene, complete1
tttgttttgcggctttgccgttgttcgggttttacctgttttcacacagcaaaacaggccttctagtttcgtgcttaaacgagatcatgctcgaactagaactacatagctggtcactggactcataccacaccttgtggagctttatgggaaaggtggctagtgggctgtggaagtgactctgaccacatgcctctcaagtgtgggaaatcacggatcggtgtagcgacgacaacaggccttgggacaccctctccagtaatggagacccaaggggccaaaagccacgcctcgtgccctgttgttcacaaccccagtgcgacccgtgttagtacctatttgcgagaactgtgtctggacagctaaacacaaccctagtgggagactaaggatgcccaggaggtacccggaggtaacaagtgacactctggatctgacctggggagagagggcttgctttacaggcgcctctctttaaaaagcttctatgtctcatcaggcaccggaggccgggccttttccttttaaaattacactta

SEQ ID NO: 578 - DNA, 539 bp, Bovine rhinitis A virus
  strain MexB15 polyprotein gene, partial1
tttgtttcgcggctctgccgctgttcgggttttacctgttttcacagagcaaaacaggacatctagtttcgtgcttaaacgatatcatgctcgaactagaactacaatgctggttaccgaacccgcaccacaccttgtggaactttgcggggaaagtgactagtgggctgtagaagtgactctgaccacatgccccatcagcgtgggaaaccacaaatcggtgtagcgacgacaacaggccttgggacaccctctccagtgatggagacccgaggggccaaaagccacgccttgtgccctgttgttcacaaccccagtgcgatttgtgttagtacctactcatgggaattgtgtttggacagctgaacacaaccctagtgggagactaaggatgcccaggaggtacccggaggtaacaagtgacactctggatctgacctggggagagggggcctgctgtacaggcgcccctctttaaaaaacttctatgtctcatcaggcaccggaggccgggccttttccttttaaaacaacatttt

SEQ ID NO: 579 - DNA, 540 bp, Human rhinovirus A
  strain HRV-A36_p1163_sR2897_2009_g2 polyprotein1
taactttgtgtttgactcccctaacatgtaacttagaagtttgaacgataagaccaataggtgataatcatccagattatcaaaggtcaagcacttctgtttccccggtcgatgaggatatgctttacccgaggcaaaaaccttagagatcgttatccacacactgcctacacagagcctagtaccacttttgacgtaactaggttggtcgctccctgcaaacccagcagtagacctggcagatgaggctggacgttccccactggcgacagtggtccagcctgcgtggctgcctgctcaccctattgggtgagaagcctatttattgacaaggtgcgaagagccgcgtgtgctcagtgtgcttcctccggcccctgaatgtggctaaccttaaccctgcagccgctgcccataatccaatgggtttacggtcgtaacgcgtaagtgcgggatgggaccaactactttgggtgtccgtgtttcttgtttttcctttatttgcattttatggtgacaatttatggtatatagattgtcatc

SEQ ID NO: 580 - DNA, 541 bp, Ovine picornavirus
  genome assembly, complete genome: monopartite.1
aaaatggggtgcatatagcatggttcccatgctgtatgctaccccattttcttccctccccctccaactaccttttccccctctattgtaacttagaagctaatacacatagcccaataggggcaccacacccagtggtgtatagggcaagcacttctgtttccccggctttgccgttaacccccacagtactacgcgactgttagtaggtaacgtaactagtgaaggttgatccggaggtaaaccccaacctccagaaacgtgagatgagggttcagtaaccccctatggtaacatagactgatccctgcgctggctcacgggcttcgtgcactgaatctaggtaaagttactgaagccacgagtgtgctactgtggtttcctccagcgccttgaatgcggctaaccctaaccccggagcacatgcatataatccaatatgtagtgtgtcgtaatgagtaattctgggacgggaccgactactttaggttgctgtgtttcctttatttttatatatcaatttatggtgacaagttacaag

SEQ ID NO: 581 - DNA, 541 bp, Human rhinovirus A
  strain HRV-A75_p1038_sR149_2008 polyprotein1
ccagttttatctcccccccccttttatgtaacttagaagttctgcacaccgaccaatagtgaacaatcagccagattgttttaggtcaagcactcctgtttccccggtcaacgttgatatgctccaacagggcaaaaacaacagcgatcgttatccgcaaggtgcctacacagagcctagtatcatcttagaagaattgtggttggtcgctcagttgcaaacccagcaatagacctggcagatgaggctggacattccccactggtgacagtggtccagcctgcgtggctgcctgcacacctctatgaggtgtgaagccagaatttcgacaaggtgtgaagagccgcgtgtgctcaccttgagtcctccggcccctgaatgcggctaaccttaaacccgcagccatggtccacaaaccagtggatgtgtggtcgtaatgagtaattgtgggatgggaccgactactttgggtgtccgtgtttcctgtttttctttttatactgcttatggtgacaatatatataggatatatattgacacc

SEQ ID NO: 582 - DNA, 542 bp, Bovine rhinovirus 1
  strain SD-1, complete genome.1
acgatctttgcggctctgccgccgttcgggttttacctgttttcacagagcaaaacaggacctctagtttcgtgcttaaacgagatcatgctcgaactagaactataacgctggtcactggacccgtgccgcgccttgcggatctttgcgggaatggtggctagtgggctgtggaagtgactctaaccacacgcccctcaagtgtgggaaaacacgaactggtgtagcgacgacgataggccttgggacaccctctccagtgatggagacccaaggggccaaaagccacgccttgtgccctgtcgttcacaaccccagtgcagttcgtgccagtacctgcttttgggaagtgtgctttggacagctgaaaacagtcctagtgggagactaaggatgcccaggaggtacccggaggtaacaagtgacactctggatctgacttggggagagcgggtctgctttacagacgccactctttaaaaaacttctatgtctcgtcaggcaccggaggccgggccttttcctttaaaacaatacacttt

SEQ ID NO: 583 - DNA, 542 bp, Human rhinovirus A
  strain HRV-A01_p1103_sR1167_2009 polyprotein1
cccccccctccccaacccttttatgtaacttagaagtttctaaacacaagaccaatagcaggcaactctccaggttgtctaaggtcaagcactcctgtctccccggttgacgttgatatgctccaacagggcaaaaacaactgatatcgttatccgcaaagtgcctacacagagcttagtagtgctctgaaagatttttggttggtcgctcagctgcatacccagcagtagaccttgcagatgaggctggacattccccactggtaacagtggtccagcctgcgtggctgcctgcacacctctcacgaggtgtgaagccaaagattggacagggtgcgaagagccgcgtgtgctcactttgagtcctccggcccctgaatgcggctaaccttaaacccgcagccatggttcacaaaccagtgaacttatggtcgtaatgagcaattgtgggatgggaccgactactttgggtgtccgtgtttcactttttcctttattgattgcttatggtgacaatatatatatagatatatattggcatc

SEQ ID NO: 584 - DNA, 544 bp, Mengo virus
  strain AnrB-3741, complete genome.1
atgtggtcgaagccacttggaataagaccggcgtgcgcttgtctatatgttacttccaccacattgccgtcttttggcaatgtgagggcccggaacctggccctgtcttcttgacgaacattcctaggggactttcccctctcgccaaaggaatgtaaggtctgttgaatgtcgtgaaggaagcagttcctctggaagcttcttgaagacaaacagcgtctgtagcgaccctttgcaggcagcggaaccccccacctggtaacaggtgcctctgcggccgaaagccacgtgtataagatacacctgcaaaggcggcacaaccccagtgccacgttgtgcgttggatagttgtggaaagagtcaaatggctttccccaagcgtattcaacaaggggctgaaggatgcccagaaggtaccccactggttgggatctgatctggggcctcggtgcaggtgctttacacctgttgagtcgaggttaaaaaacgtctaggccccccgaaccacggggacgtggttttcctagaaaaccactatgacaat

SEQ ID NO: 585 - DNA, 546 bp, Human pegivirus
  gene for polyprotein, isolate 56330265.1
ggggggttgatccccccccctcggcactgggtgcaagccccagaaaccgacgcctatctaagtagacgcaatgactcggcgccgactcggcgaccggccaaaaggtggtggatgggtgatgacagggttggtaggtcgtaaatcccggtcaccttggtagccactataggtgggtcttaagagaaggttaagattcctcttgtgcctgcggcgagaccgcgcacggtccacaggtgttggccctaccggtgtgaataagggcccgacgtcaggctcgtcgttaaaccgagcccgttccccacctgggcaaacgacgcccacgtacggtccacgtcgcccttcaatgtctctcttgaccaataggcgtagccggcgagttgacaaggaccagtgggggccgggggcctggagagggactccaggtcctgcccttcccggtgggccgggaaatgcatggggccacccagctccgcggcggcctgcagccggggtagcccaagaacccttcgggtgagggcgggtggcatttctcttttctataccatc

SEQ ID NO: 586 - DNA, 548 bp, Bat sapelovirus
  strain Henan-Mr221 polyprotein gene, complete cds.1
ggtaaactggtgttgcggcaccagtttatcctcatctcatttcccccctccccctccaaataccttttccccctcaatcggacggattctcaggcttaaacggtggaggataccccttcaaggtccgcaggtgccaagtctaaaacctgaattggaagccctttgctatcagctcatttggccgataacccctgaccgggtgtgtaggacaattgagacgctctgggtgtacgactgcctatggtagaggtagagtgtacaagtaaaggctcctttttggataccgctaggcgaatgttgagatttctcctaccctagcacttgtgcatatgactaaggggggggccccttagtttgtctactgctgcctgacagggtcgcggctggccgaccataggtagtatagtcagttgatttaacacatggattgcttcaagttccttacaacctacaaacaaaccttcaaagctcaccagtgccaccagtattggttcactgtgtgtgaacaaaaacaagtaactgtagcaaagaagagccccggccccaaa

SEQ ID NO: 587 - DNA, 548 bp, Turkey avisivirus
  strain turkey/M176-TuASV/2011/HUN polyprotein1
ttcactcgctttccccccctctctataggggcggtcttttaattcttattaatttcctactttactatcaaatttcttctaagtagggactgaggtcacttagccctccctctcctgggctttccagggttatagaggttctaaagctaagccatgtgtcttgagctacacttagtacaaaggtttagtaatgattgtacatgccagtaaccttctagtgcccatggattaaagagtggtaacactctccatggggcccgaaaggctagtgggcatagttggcatcaaggaaggggtccccaccccaacctgaattgctggctagaagctcaccttagaagaagtgctgggtgacaacgtgtccaatcgtgaacgactgatggaaacgtgtggagatggatatgtgggggttcactgagtagatgccctgaaggagaaatctgatcaggggcccgtgactatacgctaggtaaaccgggtataaaaaccatgaaaggtggcccaaaatctcttccttttattttatttctatgttggtgacagtcaag

SEQ ID NO: 588 - DNA, 548 bp, Human parechovirus 1
  isolate ETH_P16_2016 polyprotein gene,1
gatacactattcgaaggcatctagcaataagaagagtggatttagggcgcttaaagcatagtgcaaataatcatttctagcctgtgttttacacagggtggcagatggcgtgccataactctactagtgagataccacgcttgtggaccttatgctcacacagccatcctctagtaagtttgtaaagcgtctgatgacgtgtgggaacttattggaaacaatagtttgctgcaaagcatcctactgccagcggaataacacctggtaacaggtgcctctggggccaaaagccaaggtttaacagaccctttaggattggttcaaacctgaactattgtggaagatatttagtacctgctgatttggtagttgtgcaaacactagttgtaaggcccacgaaggatgcccagaaggtacccgtaggtaacaagtgacactatggatctgatctggggccaactatctctatcttgatgagttggttaaaaaacgtctagtgggccaaacctgggggggaccccagtttccttttattttataatgccact

SEQ ID NO: 589 - DNA, 548 bp, Human rhinovirus A
  strain HRV-A18_p036_s2916_1999_g1 polyprotein1
catgtacgccagttttatatcccctctccccttttgtaacttagaagataagcacaaagaccaataggtggtggctatcccagtcactaaaggtcaagcacttctgtttccccggtcgatgttgatatgctccaccagggcaaaaacaacagagatcgttatccgcaaagtgcctacacaaagcctagtaacactttgaatggtatgtggttggtcgctccgctattccccatagtagacctggcagatgaggctagaaatcccccactggcgacagtgttctagcctgcgtggctgcctgcgtgtcctaacgggcacgaagccatatacttgacaaggtgtgaagagccccgtgtgctcactttgagtcctccggcccctgaatgtggctaaccctaaccctgcagctgaggcacacaacccagtgtgaactcagtcgtaatgagcaattgcgggatgggaccaactactttgggtgtccgtgtttcacttttttttcttttataatgcttatggtgacaatatataacaatttatatattggcacc

SEQ ID NO: 590 - DNA, 548 bp, Human rhinovirus A
  strain HRV-A67_p1130_sR2849_2008 polyprotein1
cgtgaagccagttttgccacccttccctaatatgtaacttagaagtttgagcaacaagaccaataggtgataatcatccagattatcaaaggtcaagcacttctgtttccccggtcgatgaggatatgctttacccaaggcaaaaaccttaaagatcgttatccacacactgcctacacagagcctagtaccacttttgatgtaattaggttggtcgctccctgcaaacccagcagtagacctggcagatgaggctggacattccccactggcgacagtggtccagcctgcgtggctgcctgctcaccctattgggtgagaagcctacttattgacaaggtgtgaagagccgcgtgtgctcagtgtgcttcctccggcccctgaatgtggctaaccttaaccctgcagccgctgcccataatccaatgggtctacggtcgtaacgcgtaagtgcgggatgggaccaactactttgggtgtccgtgtttcttatttttcctatatatttgcttatggtgacaatatataattacttgtatattggcacc

SEQ ID NO: 591 - DNA, 550 bp, Human parechovirus 8
  isolate ETH_P25_2016 polyprotein gene, partial1
ggaccccattattcgagggcatctagcaataagaactggagattaaggacgctcaaagcatagtgtaagtattcttttctaacctgtgttttacacagggtggcagatggcgtgccataaccctattagtgagataccacacttgtggaccttatgctcacacagccatcctctagtaagtttgtaaggcgtctgatgacgtgtgggaacttgttggaaataatggtttgctgtaaagcatcctactgccagtgggtaaacacctggtaacaggtgcctctggggccgaaagccaaggtttaacagaccctttaggattggttcaaacctgaactattatggaagacacttagtacctgctgatttggtagttgtgcaaacactagttgtaaggcccacgaaggatgcccagaaggtacccttaggtaacaagtgacactatggatctgatctggggccaaccacctctatctcggtgggttggttaaaaaacgtctagtgggccaaacccaggggggaccctggtttccttttatttatcataaacaat

SEQ ID NO: 592 - DNA, 550 bp, Coxsackievirus
  A7,strain VEN/2018-23121A polyprotein gene, partial1
tatcagtagactgcttacgcggttgaaggagaaaacgttcgttacccggctaactacttcgggaaacctagtaacaccattgaagctgcagagtgtttcgctcagcacttcccccgtgtagatcaggtcgatgagtcactgcaaacctcacgggcgaccgtggcagtggctgcgttggcggcctgcctatggggtaacccataggacgctctaatgtggacatggtgtgaagagtctactgagctggttagtagtcctccggcccctgaatgcggctaatcctaactgtggagcgcatacttccaaaccagggagcagtgcgtcgtaatgggcaactccgcagcggaaccgactactttgggtgtccgtgtttccctttattcttatattggctgcttatggtgacaattgaagagttgttaccatatagctattggattggccatccggtgtgcaacagagcaattatatacctatttgttggatatattccactgacatttaagtcactcaatactctacagtacatcttgaatttaaacaccagaaa

SEQ ID NO: 593 - DNA, 550 bp, Rhinovirus C
  isolate E0-165 polyprotein gene, partial cds.1
ggctcttccgatctgccgcaactttctttcactctttgtttctggtaatttagaagttgacacagagtccaatagggtgcagctaatccaagactgctacggacaagcacttctgtctccccgggtgtgtgaatagactctaacagggttgaagctgtagcactcgttatccgcacaactactacgcgaatgttagtaacaccctctaagtatagtgggatttcgctccgcagataccccatctgtagattggggtaatgaggctacacataccccactggcgacagtggtgtagcctgcgtggtgccctacctggggttctttaccccaggattccactttactgacagggtgtgaaggcgctagtgtgctagttgtgagtcctccggtccctgaatgtggctaatcctaaccccgtggccattacatgtaacccaacatgcagatggtcgtaacgagtaatcacgggatggaaccaactactttgggtaaccgtgtttcctgttttactttaatgtgtgtatcttatggttacaactatagagtaacc

SEQ ID NO: 594 - DNA, 551 bp, Encephalomyocarditis virus type 2
  isolate RD 1338 (D28/05)1
aaatactggtcgaaaccgcttgggataagaccggggtttgttaatgtctcaatgttattctccacccaattgacgtcttttgtcaattggagggcagtgaaaccttgcccttgcttcttgcagaggattcccagtggtctttccgctctcgacaagggaattcatgatccaccaaaagttgtgaagagagcaggtcccatggaagctttctgacgactgatgatgactgtagcgaccctttgcaggcagcggacccccccacctggtgacaggtgcctctgcggccaaaagccacgtgtttaacagacacctgcaaaggcggcacaaccccagtgcctcatcaaaagtctgatgactgtggaaatagtcaaccggcttttcttaagcaaatttggtgtcggggctgaaggatgcccggaaggtaccacactggttgtgatctgatccggggccacagtacatgtgctttacacatgtagctgcggttaaaaaacgtctaggccccccgaaccacggggacgtggttttcctttgaaaaccacgattacaat

SEQ ID NO: 595 - DNA, 552 bp, Coxsackievirus
  A24, clone V19C2 polyprotein gene, partial cds.1
agactgtacccacggttgaaaacgactgatccgttatccgctttagtacttcgagaagcctattaacaccttggaatcttcgatgcgttgcgctcagcactcaaccccagagtgtagcttaggtcgatgagtctggacatacctcaccggcgacggtggtccaggctgcgttggcggcctacctgtggtccaaagccacaggacgctagttgtgaacaaggtgcgaagagcctattgagctactaaggagtcctccggcccctgaatgcggctaatcccaaccacggatcaggtgctcacgagccagtgagcggcctgtcgtaacgcgcaagtctgtggcggaaccgactactttgggtgtccgtgtttcctttttaactttatcatggctgcttatggtgacaatcgaagattgttatcataaagcgaattggattggccatccggtgaaaattaaatatatagtttacctgtttgttggatttattccactaacacaacatacttggaaattactcaactttgtgttgttaatcagacactgttaccaca

SEQ ID NO: 596 - DNA, 552 bp, Human rhinovirus A
  strain HRV-A55_p1275_s6474_2000 polyprotein1
ttccggtaactttgtatgccagttttatcacccttcccccacgtaacttagaagatgtacacttggaccaataggcgataatcctccagattatctaaggtcaagcacttctgtttccccggtctaaactgatatgctccaacagggcaaaaacagtgcagatcgttatccgcaggatgcctacgcaaagcctagtaattcctttgaagatatttggttggtcgttccactattccccatagtagacctggcagatgaggctagaaactccccactggcgacagtgttctagcctgcgtggctgcctgcacaccctcttgggtgtgaagccaaatattggacaaggtgtgaagagccccgtgtgctcatcctgagtcctccggcccctgaatgtggctaaccttaaccctgcagctagtgcatgcaatccagcatgtagctagtcgtaatgagtaattgcgggatgggaccaactactttgggtgtccgtgtttcactttttaccttatatttgcttatggtgacaatatatatagtatatatattggcatc

SEQ ID NO: 597 - DNA, 553 bp, Bovine picornavirus
  genomic RNA, complete genome,strain:1
ttgaaagacctcggcatatatcgttgtcacaacggtatatgtcgagatctttctccccaccccctccaattcccttttccccctcttgcaacttagaagtttgtacacacagggcaataggatacgtgatccagccaggacacgtgagctcaagcacttctgtttccccgtccccttcacgtactacgggaatgttagtaatttgtgtgcactttagtaaggttgatccgggattaaccccaaatcccagaaactggtgatgagcgttaccacccccgccgggcgaccggaaggtttcgctgcgttggcaccagggcttcggcaccagaaaaaggtaaagcaaatgaaggcgctactgtgctacgagaagtttcctccaggcccctgaatgcggctaatcctaaccagtgatccaccggtgcaaaaccatgtactaggtggtcgtaacgcgcaagtcgctggcggaaccgactactttgggtgtcctgtgtttccatattttattttattcaattttatggtgacaagagtaaagagatacagatttgcagcc

SEQ ID NO: 598 - DNA, 554 bp, Human rhinovirus A
  strain HRV-A23_p1216_sR3071_2008 polyprotein1
taggtaactttgtgtttgatgccagttttatcctcccctcccccatgcaacttagaagttttgcacagagaccaataggcagtaatcatccagattacttacggtcaagcacttctgtttccccggtcaaagttgatatgctccaccagggcaaaaacagctgcgatcgttatccgcaaagcgcctacgcaaagcttagtagcattctggaagttgtctggctggtcgctccaccatttcccctggtagacctggcagatgaggctagaaattccccactggcgacagtgttctagcctgcgtggctgcctgcacaccctctgggtgtgaagccatacaatggacagggtgtgaagagccccgtgtgctcgctttgagtcctccggcccctgaatgtggctaaccttaaccctgcagctagagcacacaatccagtgtgtttctagtcgtaacgagcaattgcgggatgggaccaactactttgggtgtccgtgtttccttgttttctttaaatatttgcttatggtgacaatatatacgcatatattgacacc

SEQ ID NO: 599 - DNA, 554 bp, Human poliovirus 1
  strain 3788ALB96 polyprotein gene, partial cds.1
gtataggctgtactcacggctgaaaacaaacgatccgttatccgcttaggtacttcgagaagcctagtaccatcttggaatcttcgacgcgttgcgctcagcactctaccccgagtgtagcttaggctgatgagtctgggcgttccccaccggtgacggtggcccaggctgcgttggcggcctacccatggctcacgccatgggacgctagttgtgaacaaggtgtgaagagcctattgagctacctaagagtcctccggcccctgaatgcggctaatcctaaccacggagcaagtgccttcagcccagaaggtagcttgtcgtaacgcgcaagtctgtggcggaaccgactactttgggtgtcccgtgtttccccttattttcattgtggctgcttgcgggactataattgattgccatcataaagcgatttggattggccatccggagaaagttaaacacgttgtttatttattcgttggattcacctcattaacccaaattacacccagcttgatatatatagtgttgccgactagacaaaatcaccacca

SEQ ID NO: 600 - DNA, 557 bp, Jotan virus
  isolate OTU7 RNA-dependent RNA polymerase gene,1
atcttattaacaatacgtattttaaaagctcttactctagtaagggtatgtggttaacataggatgtaatacccatttatggatattgcatcttgtggagttagtcctcacacatacttgtctagcacctgcattccaaggagtatttgcgaaaatcttattcttaaaaccaattcttaattttaagtacaaacctcgcagaacttacaaatcgtgctcacgccttttgttctatttagttaatttgtatttgaagaatttagacgaataatataacgtgcttattattcacgagaccctctaacgtttttaacgcattgatctcgtaaaatctaaagactgatcttacattgatattgaattaaactaaagaaacgcaccacgacagtagtgtggccttactgttaaaacaactaggcctaacgagtatttctaactgtgacgttcgatgaattattccgaactatgtactaactgatctaaatcgttgttctacaaggaacgtttcaccgcctcaatagatcctaactatagaggaaaagaaacaacaaacaaac

SEQ ID NO: 601 - DNA, 557 bp, Fathead minnow picornavirus
  strain 09-283, complete genome.1
ttgaaagagagtccatacggggaactgcggttctcctattggattctgctttcacagtttctgagcactggtaagagcttagacaaacgtttttaaaatttattttctctgcaacttttgtttgtgtttatttttatttgttaattttgtgcctaaacatttgttgcgaagtatttgattcattagcaatattcattattgtttatttagatggcattcaaagtggtgggagtatcgaacccaagcgtcgtatgttatctccttgaataattttggattttttcgacatgatcattgaaaaggataagtgtttaagaactcaaggagtgttaacaatggtgggtgacaggtgtccccatataatttgttaacatgatttggactggttatctagtaagaagaaccatcgaacgcacgagcgagcattgcttgcggggcagttaccctgcgtcgatgtaagtgtgtaccggggggtgcacatgttgattctttatggcctgatagggtgcgtcattcgcgcctagataattagtataatgcgaatggaataaatttac

SEQ ID NO: 602 - DNA, 557 bp, Foot-and-mouth disease virus
  type A, isolate A/ALG/3/2017, partial1
acaagttcagcagttttgcccgttttcaggagaaacgggacgtcagcgcacgaaacgcgccgccactttcggaacacttgtacaaacacgatctgacgcaggtatccctaactggcattctcgtgcaacttggagtctcgcctggtctttccaggtctagggaggcaacactttgtactgaaaccaactccacaactggtctactggcgggtgctagtaacgactttgttgcttcgtagcggagcatgcgagccgcgggaactcccccctggtaacagggacccgcggggccgaaagccacgtccctcggacctcgcatgtgtgcaaccccagcacggcaacactgtagtgaaacacactttaaggtaacactgagactggtacttggtttctggggacaggctaaggatgccctccaggtaccccgaggtaacaagcgacactcgggatctgaggaggggactggggcttctataaaagcgcccagtttaaaaagcttctatgcctgaataggtgaccggaggccggcaccttttcttttgtacacgaatcacttt

SEQ ID NO: 603 - DNA, 557 bp, Coxsackievirus
  A14, isolate ETH_P25/A14_2016 polyprotein gene,1
ggataaagaggctactcacgtggttgaaggagaaaacgtccgttacccgactaactacttcgagaaacctagtagcaccattgaacctgcggagcgtttcgctcagcacttcccccgtgtagatcaggctgatgagtcactgcactcctcacgggcgaccgtggcagtggctgcgttggcggcctgcctatggggcaacccataggacgctctaaagtggacatggtgcgaagagtctattgagctagttagtagtcctccggcccctgaatgcggctaatcctaactgcggagcgcataccctcaatccagggggtggtgtgtcgtaacgggcaactctgcagcggaaccgactactttgggtgtccgtgtttccttttattcttacactggctgcttatggtgacaattaaagaattgttaccatatagctattggattggccatccggtgtgcaacagagcgatcatttactcctttgttgcttttattcccttgaacttcacttctttgagcacactaaattatatactccatctcaactccaagaagcgagt

SEQ ID NO: 604 - DNA, 558 bp, Picornaviridae sp.
  isolate muf160pic1 genomic sequence.1
tttgtggggtgggctcccactttattcatagcccatctgctctgactctacctattgacccgtaactggtactcgtttgagattgactggtttaaagattttggtgtggttctttaggaaggattagctcgatcctttaggtgggacttatttttaccactacagagcacctatgattagttatagacagtggaggaaccattagtaactctttggaatgcgtaactgctaatcctgtgcccttggccaagacatagtaatatgttccaaggggcccaaaaggctagtgggtaaaaacccacctgggatggtcacttctgtgaattctgattagtgaagtttggattccgaatcctgtctagctaaaagtggggttagatggcactgagtagatgccctggaggtaccaattgatctgaccaggggcctagatacttaatgctaggttaaaaactatgaaaggtaagccatcgaaaattattttcctatttttactttgtttaactgattagtgaaatttactaatatttagctaggccttgctttattttattaagg

SEQ ID NO: 605 - DNA, 560 bp, Red-capped plover megrivirus
  polyprotein gene, complete cds.1
gggggttttccccctgggagtcttttccgttgggtctgtggcttggttgaaccatggatctggcgttagccggcatagtggtctgcggaaaagggccctcacgcggctgcggcttcgtgagctgttcttttccactagtgggccatctatgttggtataagctcaaccacccaaattttgtaacggccaattaagcttaggtcccgcacagattcgttctggcgtgctttataggaataggcggtctgactcggttttgtcttgacaactctcttgtttttccctttggctttgttttctttttaggctaacggttcagccttgttcagaacggccctatggcaagtgggcctagtaggttcttggtgttttccgttagtcgacccatccatagtgctagactaggtgggcgtgaggtaaaacgggacgcgtttttcgctatcccaatgaccggacctctgttgaatgcgctggatctccgcgtagccagaggaaaccacccgaaccctgatggcaactgacggtagtagggctcgtagtcagcctcatgttacccgtgg

SEQ ID NO: 606 - DNA, 560 bp, Hepatovirus G2
  isolate M32Eidhel2010 genomic sequence.1
gtcatgtttctctttaagaacactcaattttggccataagtgagactcttgtcgaacctttcatgtcaggaccatgttagggccattatccttttccctggggcattcttcttgcccctgtttcatctttctatcatctttcttccgggctctcacaatgccaatggagcgaccgatgcgcacgtcggggttaacccatggattagccatgggctgtagctgctaaaagttgtgactcctgaagcatactatcaatggtagtagatgtaactgaaacactgaagcttctctgatcttgaaagaagggtaggctacgggtgaaacccttcaggttaatactcatattgagagatacctttggtaggttaacgttggcggataatgttgagtttaacgacaataaacattcaacgcctgtgggcgaacctcaccaatttcatgctttgaagtgaatgtgcgtagggtctctatcggagatgctatgtggatggtgccctccctggaaacaggttgtaggggtactcaggtgcacttaggtttccacattttaaagatttttc

SEQ ID NO: 607 - DNA, 560 bp, Tortoise rafivirus A
  strain WHWGGF74766 polyprotein gene, complete1
tgcgaatttattcgcacagtctcttttcccccatcttgtgtgtgtgatggggtaagccgcagagtaatacctactctgctgcaaacacactcactcttttctatctactttatatcatgtaataataagtagggaacatattcaattcatattgttcatctcactgaacccgcatgaaggactgcattgcatatcctggacgaagtgacgtggaatatttggacatttatggattggacaccattacgctttgtgcctctacggagatgtaaccataatcttaagtagtagtaccccagcacaagaggataaagtggcatacacgacaacgggtgttgctcgcaccttagtaatgtggatgttcacccttggagcgtgctgaaactctgtgggtaaagacacacattagtacaaatgtgggggaactcactgaaagggcatgtcccgtgtactggtgtgccggaaagtgggggtcgctttctggagaacttagtagttcttgttattgggtgatagccttgcggcggatcaactcacagttttaatccgttgttttgcat

SEQ ID NO: 608 - DNA, 560 bp, Enterovirus A71
  isolate DK16-06 polyprotein gene, partial cds.1
tccccggactgagtatcaataggctgcttgcgcggctgaaggagaaaacgttcgttacccggccaactacttcgaaaagcctagtaccaccatcaatgaggcagagcgtttcgctcggcactaccccagtgtagatcaggctgatgagtcactgcaatccccatgggcgaccatggcagtggctgcgctggcggcctgcccatggaggaatccataggacgctctaatttggacatggtgcgaagagcctattgagctagttggtagtcctccggcccctgaatgcggctaatcctaactgcggagcgcacacccacaaaccagtgggcagtgcgtcgtaacgggcaactctgcagcggaaccgactactttgggtgtccgtgtttccttttattcctatattggctgcttatggtgacaaacgaagagttgttaccatatagctattggattggccatccggtgtgtaacagagcaattgtctatcagttcgttggttttgtaccattacattaaagtccttaacacattacatttatcttgaccctaaatacaaaagc

SEQ ID NO: 609 - DNA, 560 bp, Human rhinovirus C30
  strain USA/2015/CA-RGDS-1045 polyprotein gene,1
cggtacacttgcacgccagtttgcctccctttccctttcccttgccaaacccccttggaacttagaagcaatacattagaccaataggaggtaacgatccatgttacctaaggtcaagcacttctgtctccccggtatgcgtggaataaacagtgcaaacggttgaagccacaattatcgttatccgcgcacaaactacgcagagcctagtactaccctgaaagtctgtaggttggtcgatcagctaatccccatagtagacctggcagatgaggcaagacactccccactggcgacagtggtcttgcctgcgtggctgcctgcacaccctctggggtgtgaagcctactgacggacagggtgcgaagagccgagtgtgctttgtgtgagtcctccggcccctgaatgcggctaatccaaccccacagctgtggcatacaagccagtatgtacgcagtcgtaacgggtaactgtgggacggaaccgactactttgggtgtccgtgtttcctgtttttctttatatatatgcttatggtgacaatagtgaatattgttacc

SEQ ID NO: 610 - DNA, 561 bp, Avisivirus
  Pf-CHK1/AsV, complete genome.1
cattcccctttccccagccatgggttaaatggcccctcaccaggttcggtgctgtctaggcttccagtaaagaagtcaaccgagcattgaacaaaacctcagtgggtatggtagttaaccccgtccactggacaactttgtcctcttaaaagtggatcaatccaccccaactccccccctagccacctgagccatggtggatagcagtgacgaaactagggaccccaatacctctagtgccaagagaattcccccctcgcgagaggtgctcttgggcccgaaaggctagttggcagggtgaagtgaaggaagctgctagcgtggcaaccttaagcgtagcccgaagctgaccttagaggttaaccctagtggaccactggatgaagctgtggaggtggtggataggaaagttggccacttgtgagtagatgcccagaaggcataaggctgatctggggccagtgactataccgttccggtaaacctggtataaaaaccatgaaagcaagtgggtttaaaatttcttctaattccttcatttcagtagtgataactggcaga

SEQ ID NO: 611 - DNA, 564 bp, Poliovirus type 2
  mRNA for polyprotein, strain PV2_6526-1_ISR06.1
tgacgttgcatagactgctcacgcggttgaaagcgattgatccgttatccgcttgtgtacttcgagaagcctagtatcgccttgggatcttcgacgcgttgcgctcagcacccgaccccggggtgtagcttaggctgatgagtctggacattcctcaccggtgacggtggtccaggctgcgttggcggcctacctatggctaacgccataggacgctagatgtgaacaaggtgtgaagagcctattgagctacacaagagtcctccggcccctgaatgcggctaatcctaaccacggagcaggcggtcgcaaaccagcgattggcctgtcgtaatgcgcaagtctgtggcggaaccgactactttgggtgtccgtgtttcctgttatttttatcatggctgcttatggtgacaatcagagattgttatcataaagcgaattggattggccatccggtgagaattgtgtcaagcgtacaactgtttgttggaatcactgtgttagctttaattctcatttaaccgattaatcaaaactacacgagaacaaaacactagcatcact

SEQ ID NO: 612 - DNA, 565 bp, Coxsackievirus
  A9,strain VEN/2018-23122 polyprotein gene, partial1
ttaccccggactgagtatcaatatgctgctcacgcggctgaaggagaaaacgttcgttacccggccaattacttcgagaaacctagtaccaccatgaaggttgcgcagtgtttcgctccgcacaaccccagtgtagatcaggccgatgagtcaccgcaatcctcacgggcgaccgtggcggtggctgcgttggcggcctgcccatggggcaacccatgggacgcttcaataccgacatggtgagaagagtctattgagctaattggtagtcctccggcccctgaatgcggctaatcctaactgcggagcagatgcctgcatgccagcgggtagtctgtcgtaacgggcaactctgcagcggaaccgactactttgggtgtccgtgtttccttttattcttgtgttggctgcttatggtgacagttgagaagttgttaccatatagctattggattggccatccgttaacaaatagagcaattatcttctcttttgttggattcgttccactgaattacaaggcactaaacacacttaatttcattttaatacttaacacatcaaa

SEQ ID NO: 613 - DNA, 565 bp, Human poliovirus 2
  gene for polyprotein, isolate pv2_6056-3T_ISR04.1
tgacgttgcatagactgctcacgtggttgaaagcgatcgatccgttatccgctcgcgtacttcgagaagcctagtatcgccttggaatcttcgatgcgttgcgctcagcgcccgaccccggggcgtagcttaggctgatgagtctggacgttcctcaccggtgacggtggtccaggctgcgttggcggcctacctatggctaacgccataggacgctagatgtgaacaatgtgtgaagagcctattgagctacacgagagtcctccggcccctgaatgcggctaatcccaaccacggagcaagcggtcacaaaccagtggctggcttgtcgtaacgcgcaagtctgtggcggaaccgactactttgggtgtccgtgtttcctgttatttttatcatggctgcttatggtgacaatctgtgattgttatcataaagcgatttggattggccatccggtgagtgttatatcgaatacttgactgtttgtcagacccactgtattagaatcacttcatatttaagtagtcaatcaaaaacagcacgaagataagacaatagtaccaca

SEQ ID NO: 614 - DNA, 565 bp, Human poliovirus 2
  gene for polyprotein, isolate pv2_6316-1T_ISR05.1
tgacgttgcatagactgctcacgcggttgaaagcgatcgatccgttatccgctcgcgtacttcgagaagcctagtatcaccttggaatcttcgatgcgttgcgctcagcgctcgaccccggggcgtagcttaggctgatgagtctggacgttcctcaccggtgacggtggtccaggctgcgttggcggcctacctgtggctaatgccataggacgctagatgtgaacaaggtgtgaagagcctattgagctacacgagagtcctccggcccctgaatgcggctaatcctaaccacggagcaagcggtcacaaaccagtgactggcttgtcgtaatgcgcaagtctgtggcggaaccgactactttgggtgtccgtgtttcctgttatttttatcatggctgcttatggtgacaatctgtgattgttatcataaagcaatttggattggccatccggtgagtgttgtatcgaatacttgactatttgccaggactactatattaaattcattttatatttgagaaatcagttaaaaacagtaggaagataaaacaataataccaca

SEQ ID NO: 615 - DNA, 566 bp, Rosavirus B
  strain rat08/rRoB/HUN, complete genome.1
tgtcttctccggatgctgttacagcatgtggacccaggagtgttttaagtgatcttctacagtctctttagtgtctatactttagagagcggtgaactgacaccgttgcttcttgcacagcccttcgtgctggtctttccggttctcgacagcgttgggcatcatggctagtcaggctaagatagcagatgatttagtgaaaagttttggattgtttggagctttgtagcgatgctagtagtgtgtgcggacttccccacgtggtaacacgtgcctcacaggccaaaagccaaggtgttaaaagcacccctactagtcccaggctttcccacctgggagctcctctcatgaaaattcctagtaattaatgattgggctattcatcaacctttctagtcaatggcttaaggatgcccggaaggtacccgcaggtaacgatgagctcactgtggatatgatccggggctctggtgcgaccgtctgtccggcgtagtcagagttaaaaaacgtgtaagcccttccaccccaagggattggggtttccccaatcatttaacaggttcatt

SEQ ID NO: 616 - DNA, 567 bp, Enterovirus C
  strain 03-4101, complete genome.1
aaaccagtaccaccacgaacaagcacttctgtttccccggtgaagctgtatagactgttcccacggttgaaaatggcagatccgttatccgcttaagtacttcgagaagcctagtatcactttggaatcttcgatgcgttgcgctcagcactctaccccgagtgtagcttaggctgatgagtctgggcataccccaccggcgacggtggcccaggctgcgttggcggcctacccatggctaacgccatgggacgctagttgtgaacaaggtgtgaagagcctattgagctacttaagaatcctccggcccctgaatgcggctaatcccaaccacggagcaagtgcttacaaaccagtgagtagcttgtcgtaacgcgtaagtctgtggcggaaccgactactttgggtgtccgtgtttcctttttatttccattgtggctgcttatggtgacaatctaagattgttatcatatagctattggattggccatccggtgatttactgagatcaaacacttgcccatttccttgttgcacccacccatttgttatatttatacaattaca

SEQ ID NO: 617 - DNA, 568 bp, Human rhinovirus
  A57, strain SC9723, complete genome.1
gagttgtactctgttattccggtaactttgtatgccagttttatttccctccccaattgtaacttagaagatgtacataaagaccaataggtggtgatcacccagatcactaaaggtcaagcacttctgtttccccggtcaaagttgatatgctccaacagggcaaaaacaacttggatcgttatccgcaaagtgcctacgcaaagcttagtaccatctttgagagcctatggttggtcgctccactgaaccccacagtagacctggcagatgaggctagaagacccccactggcgacagtgttctagcctgcgtggctgcctgcacacccctacgggtgtgaagccatacgtttgacaaggtgcgaagagccccgtgtgctcactttgagtcctccggcccctgaatgtggctaaccttaaccctgcagctagtgcatacaaaccagtatgttgctagtcgtaacgagcaattgcgggatgggaccaactactttgggtgtccgtgtttcactttttacctttattttgcttatggtgacaatatatatagcatatatattgacacc

SEQ ID NO: 618 - DNA, 569 bp, Porcine kobuvirus
  gene for polyprotein, complete cds,strain:1
aagggggtgggggggcttcggccctctcaccctcttttccggtggccacccgcccgggccaccgttactccactccactccttcgggactggtttggaggaacacaacagggcttcccacccctgtttaccccgatttcatctacccttctcccgaactgaccctatccacaccccactgactaactcctttggattagacctcggaatgcctacttgacctcccacttgcctctccctttctggattgccggtggtgcctggcggaaaaagcacaagtgtgttgcaggctaccaaactcctacccgacaaaggtgcgtgtccgcgtgctgagtaatgggataggagatgcctacaacaggctcgcccatgagtagagcatggactgcggtgcatgcgacttcggtcgccacgggcatagcattgctcacccgtgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 619 - DNA, 571 bp, Picornaviridae sp.
  isolate yc-1, complete genome.1
ttcgtgttgggagaaccgtccaaaagaccctccggggttaaaccccggaagggcttttggacggttctcccaacacgaaagattgggacacttctcgtggtgagtgcttcactgcgacccgatggtgttatggagggcttccatcccgccgtttgcctaggctataggctgttttatttcttctttatttttctctatttccaggttgtctccataccgagagctgctaccgctgcgcccggcggggttaactccagggctagcctggagctgtggccgccaaaagtggagagagtgtgactaactgggatggtccgtcctgagtggctgtttccttgcacatactaaacattgatctgggtgctcaggtaggctacgggtgaaacctgaggtgtaataatgttcttctgttgaagaaactgcacgtcaaacgctaaccttatcagatatagctgagatttaagtgtcaaaaagctatcaatgattgcgggggggtgtaaggccaccttgcgatgtttggttgtgtgaggttaagaggccctcttgatggggtttccctaggcactcccct

SEQ ID NO: 620 - DNA, 571 bp, Human enterovirus
  isolate EV/Human/CMRHP52A/CMR/2014 polyprotein1
tttccccggtgatgttgtatagactgtacccacggttgaaaatgactgatccgttatccgcttttgtacttcgagaagcccagtatcatcttggaatctccgatgcgttgcgctcagcactcgaccccagagtgtagcttaggtcgatgagtctggacgttcctcaccggtgacggtggtccaggctgcgttggcggcctacctgtggcccaaagccacaggacgctaggtgtgaacaaggtgtgaagagcctattgagctacagaagagtcctccggcccctgaatgcggctaatcccaaccacggagcaagggtgcacgaaccagtgtatgccttgtcgtaatgcgcaagtctgtggcggaaccgactactttgggtgtccgtgtttccttttatttttatattggctgcttatggtgacaatcatagattgttatcataaagcgaattggattggccatccggtgaaagcaaaacacattatttacttatttgttggatttactccactcaataattttacctataaactcattacatcagtcttgctgattagaaataagtatcata

SEQ ID NO: 621 - DNA, 572 bp, Coxsackievirus
  A9, isolate NSW-V20-2008-CVA9, complete genome.1
acttctgtttccccggaccgagtatcaataaactgctcacgcggtcgaaggagaaaacgtccgttacccggccaactacttcgagaaacctagtaacaccatggaaattgcaaagtgtttcgctcagcacacccccagtgtagatcaggccgacgagtcaccgcgttccccacaggcgactgtggcggtggctgcgttggcggcctgcccgtgggacaacccatgggacgctttaatatggacatggtgtgaagagtctattgagctagttggtagtcctccggcccctgaatgcggctaatcctaactgcggagcatgcgcccccattccagagggtagcgtgtcgtaacgggcaactctgcagcggaaccgactactttgggtgtccgtgtttccttttatcttctcattggctgcttatggtgacaattgcgagattgttaccatatagctattggattggccatccggtgtctaacagagctataatataccaatttgtgggattcgttccattaagtttgaaagtcttacaaaccctcaacttgatactgcaactcaatagtgtaaa

SEQ ID NO: 622 - DNA, 573 bp, Encephalomyocarditis virus
  isolate Sing-M100-02, partial genome.1
cccccccctccccctcccccttattttcctggtcgaaaccgctcggaataagaccggggtcttgtaatgtctaaatgttacttctacccaaccattgtctatgatggttggagggctgtagaacctagcccttgcttcttgcagagaaatccaagtggtctttccactctcgacaatgggtttcatggctcgccaaaagttgtgaagaaagcaagtcctatggaagctttctgacgaccgatgatgtctgtagcgaccctttgcaggcagcggaatcccccacctggtaacaggtgcctctgcggccaaaagccacgtgtttaacagacacctgcaaaggcggcacaaccccagtgccacatcaagagtctgatgactgtggaaatagtcaactggcttttcttaagcaaatttggtgtcggggctgaaggatgcccggaaggtaccacactggttgtgatctgatccggggcccatgtgcatgtgctatacacatgtagcctgggttaaaaaacgtctaggccccccgaaccacggggacgtggttttccttttgaaaaccacaatgataat

SEQ ID NO: 623 - DNA, 574 bp, Dolphin pegivirus
  isolate DPgV, complete genome.1
cgcaccggtacttggtgcacacagtcaggttagtccgctgtgtgcaagtggtggtcccacaaaccgactgccgccctctaacgtggttttagaatgcggacgccaagtctgcaactggacgaagcgctaccggcagcgctctcctggtcgcttgagggactggagggttgcactgttagtgaataagtccggggggataagctaagggggccgtacccacggcccgcctcacgcctctgccctgctcacctaagctgatgcggacgactccatgctatggtagcagcacggtctcacaggttgtgcaaccggtggaaaaatgctccgtcaggcgcagctgacgttaaactcagtgcccccgcgctcttgcgtggtttccgggctggaagtacgccgccttcctaaagtcgttactcggccaatacattctcgggcgggttgacaaacggaaagcgcggacccatagctccgggcgggggggtatagtccatgggggggcccaggcggcacgcctgcgacacgtggcaaggggaaaaatccttcgggtgaccccgggccccatcttcttttcttt

SEQ ID NO: 624 - DNA, 574 bp, Human rhinovirus A
  strain HRV-A01_p1143_sR2058_2009 polyprotein1
ttgagtgctctgttattccggtaactttgcacgccaattttataacccctcttccccatgtaacttagaagttttacaaatagaccaatagcaagcagcgaaccagctgtacaaggtcaagcacttctgtttccccggtcaatgttgatatgcttcaacaaggcaaaaacaacagcgatcgttatccgcaagatgcctacacaaagcttagtacctccttcgatggtatttgtctggtcgctcaggtgtttccccaacactagacctggcagatgaggctagaaactccccactggcgacagtgttctagcctgcgtggctgcctgcacaccctttcgggtgtgaagccaaatactggacaaggtgtgaagagccccgtgtgctcatcttgagtcctccggcccctgaatgcggctaaccttaaacccgcagccattgctcacaatccagtgagcagatggtcgtaatgagcaattgtgggatgggaccgactactttgggtgtccgtgtttcactttttcctttatcaattgcttatggtgacaatatatatataaatatatatattggcatc

SEQ ID NO: 625 - DNA, 575 bp, Picornaviridae sp.
  isolate ybw202pic02 genomic sequence.1
cccgttggtagggggtgctaatacctaccacccgtttgccgtgggaaacggctatggagggtcgggacgcctcgttaatcacgttctagtaattgagtgtgttactttaaatcttacacttatctatttagagtagttaatgtttctactattctttactatatatatcatagctgtcgtcttgctaagagctccgaccactgcgcccggtggggttaaccaatggactagccattggctgtaggcgccagaagagacgacctcctgactatgattgagatttgtcttgcttcagggctgtggaccatggatgtgatcgatcgaaccagggaaggtaggctacgggtgaaaccttccatgtaatgatgatgtcatattgacataccgcatccatacgctaatgcagcggatattgctgagatgataagtcaataagcattcaacgttggtgcccaggtgtcatggctggggcgcggttgcgtgcgtggttcacagtataacttgaagtgtcccttaagataaatctcactctaagggaggaccctgctagtaatagtacagggctaatcaggggc

SEQ ID NO: 626 - DNA, 576 bp, Porcine kobuvirus
  strain KobuV/Pig-wt/ESP/P461/2017, complete1
tttggaaaaaggtggggggggcttcggccctctcaccctcttttccggtggccacccgcccgggccaccgttactccactccactccctcgggactggtttggaggaacacaacagggcttctcatccctgtttacccttattccacttacccttctccccgaactacccaacccactccccactgattgactcccttggattaagacctcggaatgtcttcctgaccttcttcttggttttcccttttcggattgccggtggtgcctggtggaaaaagcacaagtgtgttgttggctaccaaactcctacccgacaaaggtgcgtgtccgcgtgctgagtaatgggataggagatgccaataacaggctcgcccatgagtagagcatggactgcggtgcatgtgacttcggtcaccaggggcatagcattgctcacccctgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 627 - DNA, 576 bp, Encephalomyocarditis virus
  ZM12/14 gene for polyprotein, complete1
tccccccctttctcttccccttccttaatttaactggccgaaaccacttgggataaggccggtgtgtgtttgtctatatgtcacttctaccacaccactgtcttttggtggtgtgggggcccagaacctggccctgtcttcttgacgagcactcctaggggtctttcccctcttgccaaaggagtgtaaggtctgttggatgtcgcgaaggaagcaatctctctgtaagcttctggaagacaagcaacgtctgtagcgaccctttgcaggcagcggatttccccacctggtaacaggtgcctctgcggccaaaagccacgtgtataacatacacctgcaaaggcggcacaaccccagtgccacgttgtgagttggatagtcgtggaaagagtttgatggctttcctcaaacgtatccagcaaaagggctgaaggatgcccagaaggtaccccattttatgggatctgatctggggccacggtgcacgtgctttacacgtgtcgagccggggttaaaaaacgtctaagcccttaagtcacggggacgtggctttccctgttaaattaacactgaaac

SEQ ID NO: 628 - DNA, 576 bp, Echovirus E30
  strain 16-I10, complete genome.1
gcctattggtactcggtccggggtaacagaagtgcttggccaaggtggctgaaggggaaaacgttcgttaaccgactaataacttcgagaaacctagtaccaccatgaaagttgcgcagtgtttcgctccacacaaccccagtgtagatcaggtcgatgagtcaccgcgttccccacgggtgaccgtggcggtggctgcgttggcggcctgcccatggggcaacccatgggacgcttcaatactgacatggtgcgaagagtctattgagcttattggtagtcctccggcccctgaatgcggctaatcctaactgcggagcaggtacccacaagccagtgggtggcctgtcgtaacgggcaactctgcagcggaaccgactactttgggtgtccgtgtttccttttattcttaaattggctgcttatggtgacaattgaaaggttgttgccatatagctattggattggccatccggtgtctaatagagcaattatctacctttttgttggattcattccactcaactataaaacactcaaaacactcatatacattgtaggtctcaacacagcaaa

SEQ ID NO: 629 - DNA, 576 bp, Rhinovirus C
  isolate CO03302015 polyprotein mRNA, complete cds.1
acccaagtggtgtagtactcttgtatttcggtacacttgtacgccagtttgccaccccttccccaagcgaacgtagaagcttacaatcccggtcaataggaggtggtgaaccacaccacttaagaccaagcacttctgtttccccggctcaagaggaatatgctttgcaaagggctgaagccccgagagtcgttatccgcatacatactacgcaaagcctagtactgtcctggaagtctgttggttggtcgctccgtcaattccccattgatagacctggcagatgaggcaggaaatcccccactggcgacagtgttcctgcctgcgtggctgcctgcacaccctcacgggtgtgaagccaactgatggacagggtgagaagagccccgtgtgctatgtatgagtcctccggcccctgaatgcggctaatccaaccccacagctgccgcacacaaaccagtgtgttgacagtcgtaatgggtaactgtgggacggaaccgactactttgggtgtccgtgtttcctttattctttcaattgatgcttatggtgacaacatcaagtgatattgttacc

SEQ ID NO: 630 - DNA, 578 bp, Porcine kobuvirus
  strain CH/KB-1/2014, complete genome.1
tttgaaaagggggtgggggggcttcggccctctcaccctcttttccggtggccacccgcccgggccaccgttacttcactccactccttcgggactggtttggaggaacataacagggcttcccaatcccctgttatcctttatcccaaacaccttttcccttaaccaaccctatccacaccccactgactgattcctttggattttgacctcagaatgcctacctgacctcccactcgcctctcccttctcggattgccggtggtgcctggcggaaaaagcacaagtgtgttgcaggctaccaaactcctacccgacaaaggtgcgtgtccgcgtgctgagtaatgggataggagatgcctacaacaggctcgcccatgagtagagcatggactgcggtgcatgtgacttcggtcaccacgggcatagcattgctcacccgtgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 631 - DNA, 578 bp, Enterovirus C99
  polyprotein gene for polyprotein, VP4 and VP2 and1
gcacttctgtttccccggtacgacgacatagattgtgcccacggtcgaaagtcgtcaatccgttatccgctttggtacttcgaaaagcctagtatcaccttggaattctcgatgcgttgcgctcagcacccaaccccagagtgtagcttaggctgatgagtctgggcactccccaccggcgacggtggcccaggctgcgttggcggcctacccatggctaacgccatgggacgctagagttgaacaaggtgtgaagagcctattgagctaccaaagagtcctccggcccctgaatgcggctaatcccaaccatggatcaagtgcgtgcaatccagcatgtagcttgtcgtaatgcgcaagtccgtggcggaaccgactactttgggtgtccgtgtttccttttatttttattatggctgcttatggtgacaatctcggattgttatcatatagcaattggattggccatccggtgagagtgagagatattatctatttgtttgtggcatttactccactagatactaacacaccaattctaattagagcagttatactaattagatcaatacatcaca

SEQ ID NO: 632 - DNA, 579 bp, Porcine kobuvirus
  isolate OH/RV11/2011, complete genome.1
tttgaaaagggggtgggggggcctcggccccctcaccctcttttccggtggccactcgcccgggccaccgttactccactccactccctcgggactggtttggaggaacataacagggcttcccatccctgtttttacccttatttccatctaccctttcccttaaccaaccctatccacaccccactgactgactcctttggattttgacctcagaatgcctacttgacctcccacttgcctctcccttatcggattgccggtggtgcctggtggaaaaagcacaagtgtgttgttggctaccaaactcctacccgacaaaggtgcgtgtccgcgtgctgagtaatgggataggagatgccaatgacaggctcgcccatgagtagagcatggactgcggtgcatgtgacttcggtcaccaggggcatagcattgctcacccctgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 633 - DNA, 579 bp, Enterovirus sp.
  C99, polyprotein gene for polyprotein, VP4 and VP2 and1
gcacttctgtttccccggtgcgatgacatagactgtacccacggttgaaagtcgttaatccgttatccgctttggtacttcgagaagcctagtacctccttggaattttcgatgcgttgcgctcaacactcaaccccagagtgtagcttaggctgatgagtctgggcattcctcaccggcgacggtggcccaggctgcgttggcggcctacccatggctaacgccatgggacgctagatttgaacaaggtgtgaagagcctattgagctaccaaagaatcctccggcccctgaatgcggctaatcccaaccatggatcaagtgcatgcaaaccagcatgtggcttgtcgtaacgcgtaagtccgtggcggaaccgactactttgggtgtccgtgtttcctttttatttttataatggctgcttatggtgacaatctcagattgttatcatatagcgattggattggccatccggtgagaataagagatattatctatttgtttgtggcattcactccacttaactcatacacaccaagtttaatcaaagcagttttactaattagatcagcataccaca

SEQ ID NO: 634 - DNA, 581 bp, Picornaviridae sp.
  isolate muf159pic1 genomic sequence.1
aatgcaaataacaatcaaggacccgtttgtggggtgggctcccactttattcatagcccataacattggtatcctgttaaactgactactggctgttctactaggtatttcaactggtttaaagattttaattttgttgaaacaggaaggattagctcgatcctttaggtgggacttatttttaccaccacagagcgcccatgaacaattaaaggtagtggaggaactattagtaaccatgtgaaatgcgtaactgctatccctgtgcccttggccttggcatagtaatatgctccaaggggcccgaaaggctagtgggtagaaactcacctagggtggtcactctgtgaatttcacatggcgaagtttagattctgaatcctactttgttgtgagtggggtcaggtgacactgagtagatgccctggaggtaccaattgatctgaccaggggcctggatacttaatgccaggttaaaaattatgaaaagtaagtcaccgaactgaaatgtttttcctttttatttcatctcatactgctgtgttgtttggtgtaatagtttgaagacacaattttccagg

SEQ ID NO: 635 - DNA, 584 bp, Canine picodicistrovirus
  strain 236, complete genome.2
gtccgtataccaacggatcgatttccctgttacagcctctttgcttccccaccccactcctctccgtggagagcctagtaggattcttgaaagcaaatgtctgttgaccccaccttcaatcccggaaggaagaaaccgagaatgagactcgtctattcccccatggtgacatggagacttgtctgcgtgtgtctcgggctcccttatgagtattgtgggagaaccgctaccctgactccgaggagtctgatgggatatgttagtacctatgaaagtaaggtgacagactttgttagtatggatacgaagagccgactgccgttggagtgtatcctccggacccgtgaatgcggctaaccctaaccccggatcaagtgcccacaaaccagtgggtggcttgtcgtaatgcgtaagtctgggatgggaccgactactttcggtgttccgtgtttcctatttattttatcaataaagtatatggtgacaatattactagtgtgatatatagcctctattgtatttttattgatcaattttaataggttatttggtggtgatttaaatagagatagttactattagag

SEQ ID NO: 636 - DNA, 584 bp, Rhinovirus
  B14, strain SC0641, complete genome.1
tactctggtattatgtacctttgtacgcctgtttcttccctacaaccccttcctaaaactcccacccatgaaacgttagaagcttgacatttaagtacaataggtggcaccacatccagtggtgtctacgtacaagcacttctgtttccccggagcgaggtataggctgtacccactgccaaaagcctttaaccgttatccgccaaccaactacgtaacagctagtatcatcttgttcttcactggacgttcgatcaggtggattccccctccactagtttggtcgatgaggctaggagctccccacgggtgaccgtgtcctagcctgcgtggcggccaacccagctcatgctgggacgcccttttaaggacatggtgtgaagactcgcatgtgcttggttgtgagtcctccggcccctgaatgcggctaaccttaaccctggagccttatgccacgaaccagtggttgtaaggtcgtaacgagcaattccgggatgggaccgactactttgggtgtccgtgtttcctatttttctttatattgtcttatggtcacagcatatatataagtatatactgtgatc

SEQ ID NO: 637 - DNA, 587 bp, Human rhinovirus C
  strain QCE, complete genome.1
catggttacccacgaggtgcagtggtcttgtattacggtacatttccataccagttttataaaccctaccctgaaacttatagaagcttgtacacaccgaccgacaggtggcaatcatccagattgtcgaaggtcaagcacttctgtttccccggtatccttgtatacgcttcacccgaggcgaaaaccgaggttatcgttacccgcaaagtgcctacgagaagcctagtatcactttggaaacctatggttggtcgctcagctgttttcccaacagtagacctggcagatgaggctggacgctccccaccagcgatggtggtccagcctgcgtggctgcctgcacaccctgtggggtgtgaagccagaaagtggacaaggtgtgaagagcctattgtgctcactttgagtcctccggcccctgaatgtggctaatcctaaccccgtagctgttgcatgtaatccaacatgtatgcagtcgtaatgggcaactatgggatggaaccaactactttgggtgtccgtgtttcttgtttttctttatatactgcttatggtgacaatagtaattcattactcttgttacc

SEQ ID NO: 638 - DNA, 588 bp, Canine picodicistrovirus
  strain 209, complete genome.2
gttcgtatgccaacggattgatttccctgttacagcctctttgcttccccaccccactcctctctgtggagagcctagtaggattcttgaaagcaaatatctgttgaccccaccttcaatcccggaaggaagaaaccgagaatgagactcgtctattcccccatggtgacatggagacttgtctgcgtgtgtctcgggctcccttatgagtattgtgggagaaccgctaccctgactccgaggagtctgatgggatatgttagtacctatgaaaataaggtgacaggttttgttagtatggatacgaagagccgactgccgttggagtgtatcctccggacccgtgaatgcggctaaccctaaccctggatcaagtgctcacaaaccagtgagtggcttgtcgtaacgcgcaagtctgggatgggaccgactactttcggtgttccgtgtttctatttattttatcaataaagttttatggtgacaatcttgtgatattaagatataaagcttttatccttttgtttattgattatcttaaatagattgcttggtggtgatttaaaatagagatagttattattagag

SEQ ID NO: 639 - DNA, 588 bp, Rhinovirus A
  isolate E0-227 polyprotein gene, partial cds.1
ggctcttccgatctgggggttgtactctattattccggtaattttgtacgccagttttatctccccttcccccgactgtaacttagaagtttatcattacggccaataggtggtagttatccaaactaccaaaggtcaagcacttctgtctccccggtcaaagttgatatgctccaacagggcaaaaacaactaagatcgttatccgcaaagtgcctacgcaaagcctagtaatgtctttgaaaatttatggttggtcgctccgctattccccatagtagacctggcagatgaggctagaaattccccactggtgacagtgttctagcctgcgtggctgcctgcgcaccctttgggtgcgaagccatacattggacaaggtgtgaagagccccgtgtgctcactttgagtcctccggcccctgaatgtggctaaccttaaccctgcagctagtgcatgtaatccaacatgttgctagtcgtaatgagcaattgcgggacgggaccaactactttgggtgtccgtgtttcactttttccttttattattgcttatggtgacaatatatatagatatatatattgacacc

SEQ ID NO: 640 - DNA, 589 bp, Human rhinovirus
  A68, strain SC305, complete genome.1
ccatgtggagttgtactctattattccggtaattttgtacgccagttttatctcccctcccccttttacataacttagaagtttgtacacatcgaccgataggtggcatttatccaaaatgttgaaggtcaagcacttctgttaccccggttaaaattgatatgctccaacagggcaaaaacagttttaatcgttatccgcaaagcaactacgcaaagcctagtatcatttttgataatatacggttggtcgctccactgtgaacccgacagtagacctggcagatgaggctggaaaccccccactggtgacagtgttccagcctgcgtggctgcctgcgtacccctttgtgggtacgaagccatatgtttgacaaggtgtgaagagccccgtgtgcttgttttgagtcctccggcccctgaatgtggctaaccttaaccctgcagctagtgtgtacaatccagtacatagctagtcgtaatgagtaattgcgggatgggaccaactactttgggtgtccgtgtttcctgtttttcttttatatttgcttatggtgacaatatatatacatcacatatatattggcacc

SEQ ID NO: 641 - DNA, 591 bp, Bat picornavirus
  strain ITA/2017/189/18-155, complete genome.1
ccccccctccctccttttcatcggctgtccgttgccgtggagcttcactatccgtagtgttgttccggaaaacggacacagcaacaccttcctccgggttggtgcttgcaatccctttccccttttgttgacttcccggactcattcgttttggctttcacattggccctagaggctatcttgttggattcctgtaccctggcaatctgaactccttcgcatgccctcccacatggtcgaggacagtaaggcgcgggaccaagagagccgggcaccagacccatttctgaattggactgccaccgccaagaattgcggagcggctctgttgtgtgagatcctcctttcccacagatagcgcatcccagtgcgtgtgtatgggggttagggtgcatacagcatccgcgactgtggtcagatgagcggaagcatctgctaggataaaggggacgcgattcgctatccccgaagcatccctcattgaggtaaagccctagtaggtgacggtggactggaatgccaccctggttccgtgcagcttgacagagtgccggccggtgctctggccacagaaatcggctgttttgggac

SEQ ID NO: 642 - DNA, 591 bp, Rhinovirus C
  strain SCH-109 polyprotein gene, complete cds.1
cccgtaggcagtatgggtgtagtactcttgtattctggtacatttgtacgccagtttttcttcccacccccaagtaacctttagaagcaattgcatccagacgagcaggcgaccaacactccacgttggttcacgtcaagcacttctgtttccccggtattagagtgttaggcttctcaagaggctgaagctcgaggtatcgttatccgcacagttactaagcagagcctagtatcactctgaccttctcactggctggtcgttcaatgagagacccactcatagacctggcagatggggctggaagtaccccactggcgacagtgttccagcccgcgtggctgcctgtccccctttctgggggaaagccgatgttaagacagggtgtgaagagccgcgtttgctaactgtgagtcctccggcccctgaatgcggctaatcttaccccacagctattgcatggaaaccaccatgtggatagtcgtaatgggcaactgtgggacggaaccgactactttgggtgtccgtgtttccttttattccatttattatctcatggtgacaacgtataagagttatatgttgtttacc

SEQ ID NO: 643 - DNA, 591 bp, Rhinovirus C
  C18-NIID JPN-2014 gene for polyprotein, partial cds.1
ccgtctacggacgtagtactcttgtatttcggtacacttgtacgccagttttcctccctccaccccttatgcaacttatagaagcttgaacttacaggcgaataggaggccagcaatccatgctggtaaacgccaagcacttctgtatccccggtattagagtgttaggcttctcacgaggctgaagcttgatatatcgttatccgcacagttactaagcagagcctagtatcatcttactctttatgctggttggtcgctcagtcagtttcccctgatagacctggcagatggggctggaaatccctcactggtaacagtgttccagcccgcgtggctgcctgtccccctccttagggggaaagccaatataaagacaaggtgtgaagagccgcgtttgctaattgtgagtcctccggcccctgaatgcggctaatccaaccccacagctatcgcatggaatccaccatgtaggtagtcgtaatgggcaactgtgggacggaaccgactactttgggtgtccgtgtttccttttataccttatctgatctcatggtgacaacatatattgacaagtgtatgttgttcacc

SEQ ID NO: 644 - DNA, 596 bp, Enterovirus C
  strain 03-4209, complete genome.1
gtaccaccacgaacaagcacttctgtttccccggtgaagttgcatagactgtgcccacggttgaaagcgactgatccgttatccgctcttgtacttcgagaagcctagtaccatcttggaatcttcgacgcgttgcgctcagcactcaaccccagagtgtagcttaggctgatgagtctggacattccccatcggtgacgatggtccaggctgcgttggcggcctacctgtggcccaaagccacaggacgctagttgtgaacaaggtgtgaagagcctattgagctacatgagagtcctccggcccctgaatgcggctaatcccaaccacggagcaggtggtcataatccaatgactggcctgtcgtaacgcgcaagtctgtggcggaaccgactactttgggtgtccgtgtttccttttatttttacaatggctgcttatggtgacaatcatagattgttatcataaagcgaattggattggccatccggtgagaatcaaatcgcttgtatatttgtttgttggatttgctccattaacattaaacaccttaacacttattaaagtagttctattgataagacattgctattaca

SEQ ID NO: 645 - DNA, 596 bp, Human rhinovirus
  B4, strain SC165, complete genome.1
gacccactgggtgtagtgctctggtattttgtacccttgcacgcctgtttcccatttgtacccttccttgatttcctccccatgtaacgttagaagtttcggaattttaaagtacaataggaagcgccacatccagtggtgttgtgtacaagcacttctgtttacccggggcgaggtataggctgtgcccacggccaaaaacctttaaccgttatccgccaaccaactacgtaacggctagtatcatcttgtttctgacttggcgttcgatcaggtggtaacccccactagtctggtcgatgaggctaggaattccccacgggcgaccgtgtcctagcctgcgtggcggccagcccagcttttgctgggacgccttttcaaagacatggtgtgaagacccgcatgtgcttggttgtgagtcctccggcccctgaatgcggctaaccttaaccctggagcccagtgacataatccaatgttatttgggtcgtaatgagtaattccgggatgggaccgactactttgggtgtccgtgtttccttttattctttataatgtcttatggtcacagcatatatattgtatatactgtgatc

SEQ ID NO: 646 - DNA, 596 bp, Human rhinovirus
  C32, strain USA/CA/RGDS-2016-1008, complete genome.1
atcccaccatgattgttcactgaacgttgtactcttgtattacggtacacttgtacgccagttttataatcccctccccttgtaacttagaagcaagtacacacaggccaatagcaagtagcaagccatgctacttatggtcaagcacttctgtttccccggtctgacgggatatgcttcacccgaggcagaaactcagatgatcgttatccgcaaagtgcctacgggaagcctagtagcaccctggaaactgttaggttggtcgctcaattgctgaccccgagcaatagacttggcagatgaggctagacataccccaccagcgatggtggtctagcctgcgtggctgcctacccaccctaatagggtgggaagcctatcaatggacagggtgtgaagagcctactgtgctcactttgactcctccggcccctgaatgtggctaatcctaaccccgtatctatcgcatgcgcaccagcatgtaggtagtcgtaatgggcaactacgggatggaaccaactactttgggtgtccgtgtttcctgttttctttattatttgcttatggtgacaattgtatgaaatacgattgacacc

SEQ ID NO: 647 - DNA, 597 bp, Human rhinovirus
  56 polyprotein gene, partial cds.1
gttgttcccacctggacttcctatgtggagttgtacactgttatcccggtaaccttgtacgccagttttatacacccttccctgtaacttagaagttataagcacgaggaccaataggtagtgactttccaggtcactaaaggtcaagcacttctgtctccccggtcaaagttgatatgctctccccagggcaaaaacaattgagatcgttatccgcaatgtgcctacgcaaagcctagtaatatcttagatgatatatggttggtcgctccgccatttcccatggtagacctggcagatgaggctagaaactccccactggcgacagtgttctagcctgcgtggctgcctgcgcactctctgagtgcgaagccatatatttgacaaggtgtgaagagccccgtgtgctcacattgaatcctccggcccctgaatgtggctaaccttaaacctgcagctagtgcacacaaaccagtgtgtagctagtcgtaacgagcaattgcgggatgggaccaactactttgggtgtccgtgtttcacttttttccttttatatttgcttatggtgacaatatatataatacatatattgacacc

SEQ ID NO: 648 - DNA, 598 bp, WUHARV Enterovirus 2
  polyprotein gene, partial cds.1
cccagtaacgttagaagaaagtacaaatgacacttagcaaatccaccaacccaggtgggttttcgtcaagcacttctgtttccccggacctagtaccaataggctgtacccacggctgaaggggaaaacgttcgttacccggctacctacttcgaaaagcctagtatcatcatagaatgtctcaagtgttacgctcagcacaaccccagtgtagttcaggtcgatgagtcaccgaattccccacgggcgaccgtgtcggtggctgcgttggcggcctgcctgcgagtttcactcgcaggacgcttgattcatgacatggtgtgaagagcctattgagctaggtagtagtcctccggcccctgaatgcggctaatcctaaccacggagccatgcgtcacaatccagtgatgtcgtggtcgtaacgagcaattctgtggcggaaccgactactttgggtgtccgtgtttcctgttttatttaccttggctgcttatggtgacaattgtatagttgtcatcatatagctattggattggccatccggatatatacaagcaactagtgttcacactacctcttttgctataacacaagtatc

SEQ ID NO: 649 - DNA, 598 bp, Human rhinovirus
  C11, strain SC1065, complete genome.1
ccaccgggcacactgtgcgtagtactctgtgattacggtcactttgtacgcctgtttgcatccccaacccacatttcctatcatcttttatatccgtaacttagaagcataacacacagtccaataggaagcagctaaaccaagactgctaaggacaaatacttctgtttccccgggcgtgtgaatagactccaacagggttgaagctgtagcgctcgttatccgcacaactactacgcgactgttagtagcactttggatagcatgtggggttccgctccacagaaaccccatctgtaggtcagggcaatggggctacacataccccactggcgacagtggtgtagcccgcgtggtgccctgcctgggactgtgtcccaggactccacttgtttgacagggtgtgaaggcactagtgtgctagttgtgagtcctccggcccctgaatgcggctaatcctaaccctgcagccattgcaaacattccagtttgtgggtggtcgtaacgagtaattgcgggatggaaccgactactttgggtgtccgtgtttctctttttaacttgatgagtgtcttatggttacaattatacagtaacc

SEQ ID NO: 650 - DNA, 600 bp, Hunnivirus 83GR
  isolate 83GR-70-RAT106 polyprotein gene, complete1
agctttcttacccttcatttgtgaacccactagtctaagccgcttggaatacgatgagtggaaacgttcattctaaatggagtgaaacatgctcaattttctagctcgtgctggtctttccagtgcggggcggccctgtctggccgtaactctacagagtgtcacgccgtgcttgcggatctcacgtggcacatgacaaggctctcgctggaactgtgagtctgatgcatgtggagtaacagtgaaaagtgcatgatcacacatttgtgtgggctatgagcctgcggaacaacaactggtaacagttgcctcaggggccgaaagccacggtgttaacagcaccctcatagtttgatctatcccaggatagtgatgttgtgtacctagtaattgccaatcctcatgtcttggtatcacggcataccggagagttcgcgggtgaaggatgcccagaaggtacccgtaggtaaccttaagagactatggatctgatctggggccctgtctggagtgctttacacacagctcagggttaaaaaacgtctagcccgccaggacccgagggattcgggttttcccttaaaaacccgattagagcat

SEQ ID NO: 651 - DNA, 600 bp, Human enterovirus
  isolate EV/Human/CMRHP35B/CMR/2014 polyprotein1R
cggtaagccacccgagttctggccaagcacttctgtttccccggactgagtatcaataagttgctcgcgcggctgaaggagaaaacgttcgttacccgaccaactacttcaagaaacccagtatcaccatggaagttgcgcagtgtttcgctccgcacaaccccagtgtagatcaggtcgatgagtcaccgcaacccccacgggtgaccgtggcggtggctgcgctggcggcctgcccatggggcaacccatgggacgcttcaatactgacatggtgtgaagagtctattgagctagttggtagtcctccggcccctgaatgcggctaatcctaactgcggagcagacgctcgcatgccagcgggtagtctgtcgtaacgggtaactctgcagcggaaccgactactttgggtgtccgtgtttccttttattcttatactggctgcttatggtgacaattgaaaggttgttaccatatagctattggattggccatccggtgacaaacagagcgattatatactcttttgttgggttcatcccattgaattacaaggtattaaacaccctcagttttatcctgatactaaatacaacaaa

(The sequence listing continues in the following parts.)

What is claimed is:

1. A precursor RNA polynucleotide comprising:
   a. a 3' group I intron fragment
   b. a core functional element, and
   c. a 5' group I intron fragment,
   wherein the core functional element comprises:
   i. a translation initiation element (TIE) comprising an internal ribosome entry (IRES) comprising a polynucleotide having at least 95% sequence identity to SEQ ID NO: 1284 or a functional fragment thereof, and
   ii. a polynucleotide encoding an amino acid sequence having at least 95% sequence identity to SEQ ID NO: 3691 or a functional fragment thereof.

2. The precursor RNA polynucleotide of claim 1, wherein the TIE further comprises a UTR or a fragment thereof, an aptamer complex or a fragment thereof, or a combination thereof.

3. The precursor RNA of claim 1, wherein the 3' group I intron fragment comprises a first or a first and a second nucleotide of a 3' group I intron splice site dinucleotide.

4. The precursor RNA of claim 1, wherein the 5' group I intron fragment comprises a first or a first and a second nucleotide of a 5' group I intron splice site dinucleotide.

5. A circular RNA polynucleotide comprising a TIE and a polynucleotide encoding an amino acid sequence having at least 95% sequence identity to SEQ ID NO: 3691 or a functional fragment thereof, wherein the TIE comprises an IRES comprising a polynucleotide having at least 95% sequence identity to SEQ ID NO: 1284 or a functional fragment thereof.

6. The circular RNA polynucleotide of claim 5, further comprising a polynucleotide comprising a sequence encoding a CAR comprising an antigen binding molecule that specifically binds to CD19.

7. The circular RNA polynucleotide of claim 5, wherein the polynucleotide encoding the amino acid sequence is codon optimized.

8. The circular RNA polynucleotide of claim 5, wherein the CAR comprises an amino acid sequence of SEQ ID NO: 3690.

9. The circular RNA polynucleotide of claim 5, wherein the circular RNA is formed from a precursor RNA polynucleotide that was transcribed from a vector or DNA comprising a PCR product, a linearized plasmid, non-linearized plasmid, linearized minicircle, a non-linearized minicircle, viral vector, cosmid, ceDNA, or an artificial chromosome.

10. The circular RNA polynucleotide of claim 5, further comprising an internal spacer sequence.

11. The circular RNA polynucleotide of claim 5, further comprising 1 to 100 natural nucleotides derived from a natural exon.

12. A pharmaceutical composition comprising:
   the circular RNA polynucleotide of claim 5; and
   b. a nanoparticle, and optionally, a targeting moiety operably connected to the nanoparticle.

13. The pharmaceutical composition of claim 12, wherein the nanoparticle is a lipid nanoparticle, a core-shell particle, or a biodegradable nanoparticle.

14. The pharmaceutical composition of claim 12, wherein the nanoparticle comprises one or more cationic lipids, ionizable lipids, or poly β-amino esters.

15. The pharmaceutical composition of claim 12, wherein the nanoparticle comprises one or more non-cationic lipids.

16. The pharmaceutical composition of claim 12, wherein the nanoparticle comprises one or more PEG-modified lipids, polyglutamic acid lipids, or hyaluronic acid lipids.

17. The pharmaceutical composition of claim 12, wherein the nanoparticle comprises cholesterol.

18. The pharmaceutical composition of claim 12, wherein the nanoparticle comprises arachidonic acid, leukotriene, or oleic acid.

19. A method of treating a cancer in a subject in need thereof comprising administering a therapeutically effective amount of a composition comprising the circular RNA of claim 5, a lipid nanoparticle, and optionally, a targeting moiety operably connected to the nanoparticle.

20. The method of claim 19, wherein the subject has a cancer selected from the group consisting of: acute myeloid leukemia (AML); alveolar rhabdomyosarcoma; B cell malignancies; bladder cancer; bone cancer; brain cancer; breast cancer; cancer of the anus, anal canal, or anorectum; cancer of the eye; cancer of the intrahepatic bile duct; cancer of the joints; cancer of the neck; gallbladder cancer; cancer of the pleura; cancer of the nose, nasal cavity, or middle ear; cancer of the oral cavity; cancer of the vulva; chronic lymphocytic leukemia; chronic myeloid cancer; colon cancer; esophageal cancer, cervical cancer; fibrosarcoma; gastrointestinal carcinoid tumor; head and neck cancer; Hodgkin lymphoma; hypopharynx cancer; kidney cancer; larynx cancer; leukemia; liquid tumors; lipoma; liver cancer; lung cancer; lymphoma; mesothelioma; mastocytoma; melanoma; multiple myeloma; nasopharynx cancer; non-Hodgkin lymphoma; B-chronic lymphocytic leukemia; hairy cell leukemia; Burkitt's lymphoma; ovarian cancer; pancreatic cancer; cancer of the peritoneum; cancer of the omentum; mesentery cancer; pharynx cancer; prostate cancer; rectal cancer; renal cancer; skin cancer; small intestine cancer; soft tissue cancer; solid tumors; synovial sarcoma; gastric cancer; teratoma; testicular cancer; thyroid cancer; and ureter cancer.

21. A eukaryotic cell comprising a circular RNA polynucleotide according to claim 5.

22. The eukaryotic cell of claim 21, wherein the eukaryotic cell is an immune cell.

23. The eukaryotic cell of claim 21, wherein the eukaryotic cell is a T cell, dendritic cell, macrophage, B cell, neutrophil or basophil.

24. The precursor RNA polynucleotide of claim 1, wherein the IRES has 100% sequence identity to SEQ ID NO: 1284 or a functional fragment thereof.

25. The precursor RNA polynucleotide of claim 1, wherein the amino acid sequence has 100% sequence identity to SEQ ID NO: 3691 or a functional fragment thereof.

26. The circular RNA polynucleotide of claim 5, wherein the IRES has 100% sequence identity to SEQ ID NO: 1284 or a functional fragment thereof.

27. The circular RNA polynucleotide of claim 5, wherein the amino acid sequence has 100% sequence identity to SEQ ID NO: 3691 or a functional fragment thereof.

28. The precursor RNA polynucleotide of claim 1, wherein the precursor RNA polynucleotide further comprises a stop codon or a stop cassette.

29. The precursor RNA polynucleotide of claim 1, wherein the IRES has 100% sequence identity to SEQ ID NO: 1284.

30. The precursor RNA polynucleotide of claim 1, wherein the amino acid sequence has 100% sequence identity to SEQ ID NO: 3691.

31. The circular RNA polynucleotide of claim 9, wherein the IRES has 100% sequence identity to SEQ ID NO: 1284.

32. The circular RNA polynucleotide of claim 9, wherein the amino acid sequence has 100% sequence identity to SEQ ID NO: 3691.

* * * * *